US012644111B2

(12) United States Patent
Zhang et al.

(10) Patent No.: US 12,644,111 B2
(45) **Date of Patent: *Jun. 2, 2026**

(54) CRISPR ENZYMES AND SYSTEMS

(71) Applicants: The Broad Institute, Inc., Cambridge, MA (US); Massachusetts Institute of Technology, Cambridge, MA (US); President and Fellows of Harvard College, Cambridge, MA (US)

(72) Inventors: Feng Zhang, Cambridge, MA (US); Ian Slaymaker, Cambridge, MA (US); Soumya Kannan, Cambridge, MA (US); Jonathan Gootenberg, Cambridge, MA (US); Omar Abudayyeh, Cambridge, MA (US)

(73) Assignees: The Broad Institute, Inc., Cambridge, MA (US); Massachusetts Institute of Technology, Cambridge, MA (US); President and Fellows of Harvard College, Cambridge, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 18/965,675

(22) Filed: Dec. 2, 2024

(65) Prior Publication Data

US 2025/0101400 A1 Mar. 27, 2025

Related U.S. Application Data

(63) Continuation of application No. 17/264,340, filed as application No. PCT/US2019/044480 on Jul. 31, 2019.

(60) Provisional application No. 62/712,809, filed on Jul. 31, 2018, provisional application No. 62/751,421, filed on Oct. 26, 2018, provisional application No. 62/775,865, filed on Dec. 5, 2018, provisional application No. 62/822,639, filed on Mar. 22, 2019, provisional application No. 62/873,031, filed on Jul. 11, 2019.

(51) Int. Cl.

| | |
|---|---|
| ***C12N 9/22*** | (2006.01) |
| ***A61K 38/46*** | (2006.01) |
| ***A61K 38/50*** | (2006.01) |
| ***C12N 9/78*** | (2006.01) |
| ***C12N 15/11*** | (2006.01) |
| ***C12N 15/55*** | (2006.01) |
| ***C12N 15/62*** | (2006.01) |
| ***C12Q 1/6823*** | (2018.01) |
| ***C12Q 1/6851*** | (2018.01) |
| *A61K 38/00* | (2006.01) |

(52) U.S. Cl.

CPC ................. *C12N 9/78* (2013.01); *C12N 9/22* (2013.01); *C12N 15/111* (2013.01); *C12Q 1/6823* (2013.01); *C12Q 1/6851* (2013.01); *A61K 38/00* (2013.01); *C07K 2319/33* (2013.01); *C12N 2310/128* (2013.01); *C12N 2310/16* (2013.01); *C12N 2310/20* (2017.05); *C12Y 305/04004* (2013.01)

(58) Field of Classification Search

None

See application file for complete search history.

(56) References Cited

U.S. PATENT DOCUMENTS

| | | | |
|---|---|---|---|
| 4,751,180 | A | 6/1988 | Cousens et al. |
| 4,897,355 | A | 1/1990 | Eppstein et al. |
| 4,935,233 | A | 6/1990 | Bell et al. |
| 4,946,787 | A | 8/1990 | Eppstein et al. |
| 5,049,386 | A | 9/1991 | Eppstein et al. |
| 5,543,158 | A | 8/1996 | Gref et al. |
| 5,563,055 | A | 10/1996 | Townsend et al. |
| 5,580,859 | A | 12/1996 | Felgner et al. |
| 5,589,466 | A | 12/1996 | Felgner et al. |
| 5,593,972 | A | 1/1997 | Weiner et al. |
| 5,789,156 | A | 8/1998 | Bujard et al. |
| 5,814,618 | A | 9/1998 | Bujard et al. |
| 5,846,946 | A | 12/1998 | Huebner et al. |
| 5,855,913 | A | 1/1999 | Hanes et al. |
| 5,985,309 | A | 11/1999 | Edwards et al. |
| 6,007,845 | A | 12/1999 | Domb et al. |
| 6,750,059 | B1 | 6/2004 | Blakesley et al. |
| 7,259,015 | B2 | 8/2007 | Kingsman et al. |
| 7,303,910 | B2 | 12/2007 | Bebbington et al. |
| 7,351,585 | B2 | 4/2008 | Mitrophanous et al. |
| 7,745,651 | B2 | 6/2010 | Heyes et al. |

(Continued)

FOREIGN PATENT DOCUMENTS

| | | | |
|---|---|---|---|
| EP | 1 519 714 | A1 | 4/2005 |
| EP | 1 664 316 | A1 | 6/2006 |
| EP | 1 781 593 | A2 | 5/2007 |
| EP | 1 766 035 | B1 | 12/2011 |
| EP | 2 771 468 | B1 | 2/2015 |
| EP | 2 784 162 | B1 | 4/2015 |

(Continued)

OTHER PUBLICATIONS

Cox et al., Science vol. 358, No. 6366 with Supplementary Material, Nov. 2017, 78 pages (Year: 2017).*

(Continued)

*Primary Examiner* — David Steadman

(74) *Attorney, Agent, or Firm* — F. Brent Nix, Esq.; Johnson, Marcou, Isaacs & Nix, LLC; Drew P. Harding

(57) ABSTRACT

The present disclosure provides for systems, methods, and compositions for targeting nucleic acids. In particular, the invention provides mutated Cas13 proteins and their use in modifying target sequences as well as mutated Cas13 nucleic acid sequences and vectors encoding mutated Cas13 proteins and vector systems or CRISPR-Cas13 systems.

20 Claims, 227 Drawing Sheets

Specification includes a Sequence Listing.

(56) References Cited

U.S. PATENT DOCUMENTS 7,776,321 B2 8/2010 Cascalho et al.
7,799,565 B2 9/2010 Maclachlan et al.
7,803,397 B2 9/2010 Heyes et al.
7,838,658 B2 11/2010 Maclachlan et al.
7,901,708 B2 3/2011 Maclachlan et al.
7,915,399 B2 3/2011 Maclachlan et al.
7,982,027 B2 7/2011 Maclachlan et al.
8,044,019 B2 10/2011 Uno et al.
8,058,069 B2 11/2011 Yaworski et al.
8,101,741 B2 1/2012 Maclachlan et al.
8,188,263 B2 5/2012 Maclachlan et al.
8,236,943 B2 8/2012 Lee et al.
8,283,333 B2 10/2012 Yaworski et al.
8,372,951 B2 2/2013 Chang et al.
8,404,658 B2 3/2013 Hajjar et al.
8,454,972 B2 6/2013 Nabel et al.
8,554,489 B2 10/2013 Bathe et al.
8,575,305 B2 11/2013 Gait et al.
8,614,194 B1 12/2013 Chen et al.
8,697,359 B1 4/2014 Zhang
8,709,843 B2 4/2014 Shakuda
8,771,945 B1 7/2014 Zhang
8,795,965 B2 8/2014 Zhang
8,865,406 B2 10/2014 Zhang et al.
8,871,445 B2 10/2014 Cong et al.
8,889,356 B2 11/2014 Zhang
8,889,418 B2 11/2014 Zhang et al.
8,895,308 B1 11/2014 Zhang et al.
8,906,616 B2 12/2014 Zhang et al.
8,932,814 B2 1/2015 Cong et al.
8,945,839 B2 2/2015 Zhang
8,993,233 B2 3/2015 Zhang et al.
8,999,641 B2 4/2015 Zhang et al.
2004/0013648 A1 1/2004 Kingsman et al.
2004/0142476 A1 7/2004 Evans et al.
2004/0171156 A1 9/2004 Hartley et al.
2005/0019923 A1 1/2005 Uchegbu et al.
2006/0281180 A1 12/2006 Radcliffe et al.
2007/0025970 A1 2/2007 Kingsman et al.
2007/0054961 A1 3/2007 Maden et al.
2008/0267903 A1 10/2008 Uchegbu et al.
2009/0007284 A1 1/2009 Radcliffe et al.
2009/0017543 A1 1/2009 Wilkes et al.
2009/0111106 A1 4/2009 Mitrophanous et al.
2010/0317109 A1 12/2010 Maden et al.
2011/0059502 A1 3/2011 Chalasani
2011/0117189 A1 5/2011 Mazzone et al.
2011/0195123 A1 8/2011 Shemi
2011/0265198 A1 10/2011 Gregory et al.
2011/0293571 A1 12/2011 Widdowson et al.
2011/0293703 A1 12/2011 Mahon et al.
2012/0003201 A1 1/2012 Nicholas et al.
2012/0017290 A1 1/2012 Cui et al.
2012/0251560 A1 10/2012 Dahlman et al.
2012/0251618 A1 10/2012 Schrum et al.
2012/0295960 A1 11/2012 Palfi et al.
2013/0185823 A1 7/2013 Kuang et al.
2013/0236946 A1 9/2013 Gouble
2013/0244279 A1 9/2013 De Fougerolles et al.
2013/0245107 A1 9/2013 De Fougerolles et al.
2013/0252281 A1 9/2013 De Fougerolles et al.
2013/0302401 A1 11/2013 Ma et al.
2014/0170753 A1 6/2014 Zhang
2014/0179006 A1 6/2014 Zhang
2014/0179770 A1 6/2014 Zhang et al.
2014/0186843 A1 7/2014 Zhang et al.
2014/0186919 A1 7/2014 Zhang et al.
2014/0186958 A1 7/2014 Zhang et al.
2014/0189896 A1 7/2014 Zhang et al.
2014/0227787 A1 8/2014 Zhang
2014/0234972 A1 8/2014 Zhang
2014/0242664 A1 8/2014 Zhang et al.
2014/0242699 A1 8/2014 Zhang
2014/0242700 A1 8/2014 Zhang et al.
2014/0248702 A1 9/2014 Zhang et al.
2014/0256046 A1 9/2014 Zhang et al.
2014/0273231 A1 9/2014 Zhang et al.
2014/0273232 A1 9/2014 Zhang et al.
2014/0273234 A1 9/2014 Zhang et al.
2014/0287938 A1 9/2014 Zhang et al.
2014/0310830 A1 10/2014 Zhang et al.
2014/0335620 A1 11/2014 Zhang et al.
2014/0342456 A1 11/2014 Mali et al.
2014/0356959 A1 12/2014 Church et al.
2014/0357530 A1 12/2014 Zhang et al.
2015/0031132 A1 1/2015 Church et al.
2015/0291966 A1 10/2015 Zhang et al.
2016/0103951 A1 4/2016 Bathe et al.
2017/0047193 A1 2/2017 Jiang et al.
2017/0166903 A1 6/2017 Zhang et al.
2019/0359971 A1 11/2019 Zhang et al.

FOREIGN PATENT DOCUMENTS

EP 2 764 103 B1 8/2015
WO 91/16024 A1 10/1991
WO 91/17424 A1 11/1991
WO 93/01294 A1 1/1993
WO 96/39154 A1 12/1996
WO 97/03211 A1 1/1997
WO 2004/015075 A2 2/2004
WO 2008/042156 A1 4/2008
WO 2008/064289 A2 5/2008
WO 2010/061186 A2 6/2010
WO 2010/096488 A1 8/2010
WO 2011/008730 A2 1/2011
WO 2012/135025 A2 10/2012
WO 2014/018423 A2 1/2014
WO 2014/093595 A1 6/2014
WO 2014/093622 A2 6/2014
WO 2014/093635 A1 6/2014
WO 2014/093655 A2 6/2014
WO 2014/093661 A2 6/2014
WO 2014/093694 A1 6/2014
WO 2014/093701 A1 6/2014
WO 2014/093709 A1 6/2014
WO 2014/093712 A1 6/2014
WO 2014/093718 A1 6/2014
WO 2014/204723 A1 12/2014
WO 2014/204724 A1 12/2014
WO 2014/204725 A1 12/2014
WO 2014/204726 A1 12/2014
WO 2014/204727 A1 12/2014
WO 2014/204728 A1 12/2014
WO 2014/204729 A1 12/2014
WO 2015/065964 A1 5/2015
WO 2015/089406 A1 6/2015
WO 2015/089419 A2 6/2015
WO 2016/049163 A2 3/2016
WO 2016/049258 A2 3/2016
WO 2016/108926 A1 7/2016
WO 2016/186745 A1 11/2016
WO 2017/070632 A2 4/2017
WO WO-2017070605 A1 * 4/2017 ........... C12N 15/102
WO 2017/189870 A1 11/2017
WO 2017/189914 A1 11/2017
WO 2017219027 A1 12/2017
WO 2018107129 A1 6/2018
WO 2018/170333 A1 9/2018
WO 2018/191388 A1 10/2018

OTHER PUBLICATIONS

GenPept Database Accession No. RKY08123, Oct. 2018, 2 pages (Year: 2018).*
Wang et al., PNAS 11:2868-2873, 2016 (Year: 2016).*
Abil, et al., “Engineering Reprogrammable RNA-Binding Proteins for Study and Manipulation of the Transcriptome”, Molecular BioSystems, The Royal Society of Chemistry, vol. 11, No. 10, 2015, 8 pages.
Abudayyeh, et al., “C2C2 is a Single-Component Programmable RNA-Guided RNA-Targeting CRISPR Effector”, Science, vol. 353, No. 6299, Aug. 5, 2016, 23 pages.

(56) References Cited

OTHER PUBLICATIONS

Abudayyeh, et al., "RNA Targeting with CRISPR-Cas13a", Nature, vol. 550, No. 7675, Oct. 12, 2017, 30 pages.
Banaszynski, et al., "A Rapid, Reversible, and Tunable Method to Regulate Protein Function in Living Cells Using Synthetic Small Molecules", Cell, vol. 126, No. 5, Sep. 8, 2006, 995-1004.
Banaszynski, et al., "Chemical Control of Protein Stability and Function in Living Mice", Nature Medicine, vol. 14, No. 10, Oct. 2008, 1123-1127.
Chen, et al., "Global microRNA Depletion Suppresses Tumor Angiogenesis", Genes & Development, vol. 28, May 15, 2014, 1054-1067.
Cong, et al., "Multiplex Genome Engineering Using CRISPR/Cas Systems", Science, vol. 339, No. 6121, Feb. 15, 2013, 819-823.
East-Seletsky, et al., "RNA Targeting by Functionally Orthogonal Type VI-A CRISPR-Cas Enzymes", Molecular Cell, vol. 66, No. 3, May 4, 2017, 373-383.
East-Seletsky, et al., "Two Distinct RNase Activities of CRISPR-C2c2 Enable Guide-RNA Processing and RNA Detection", Nature, vol. 538, No. 7624, Oct. 13, 2016, 17 pages.
Fonfara, et al., "The CRISPR-associated DNA-cleaving Enzyme Cpf1 also Processes Precursor CRISPR RNA", Nature, vol. 532, Apr. 28, 2016, 19 pages.
Fukuda, et al., "Construction of a Guide-RNA for Site-Directed RNA Mutagenesis Utilising Intracellular A-To-I RNA Editing", Scientific Reports, vol. 7, No. 41478, Feb. 2017, 13 pages.
Fukui "DNA Mismatch Repair in Eukaryotes and Bacteria", Journal of Nucleic Acids, vol. 2010, Article 260512, Jul. 27, 2010, 16 pages.
Gao, et al., "Engineered Cpf1 Enzymes with Altered PAM Specificities", BioRxiv, Dec. 4, 2016, 17 pages.
Gao, et al., "Engineered Cpf1 Variants with Altered PAM Specificities", Nature Biotechnology, vol. 35, No. 8, Aug. 2017, 789-792.
Gaudelli, et al., "Programmable Base Editing of A•T to G•C in Genomic DNA Without DNA Cleavage", Nature, vol. 551, No. 7681, Nov. 23, 2017, 464-471.
Gietz, et al., "Large-Scale High-Efficiency Yeast Transformation using the LiAc/SS Carrier DNA/PEG Method", Nature Protocols, vol. 2, No. 1, 2007, 38-41.
Gootenberg, et al., "Multiplexed and Portable Nucleic Acid Detection Platform with Cas13, Cas12a, and Csm6", Science, vol. 360, No. 6387, Apr. 27, 2018, 439-444.
Gootenberg, et al., "Nucleic Acid Detection with CRISPR-Cas13a/C2c2", Science, vol. 356, No. 6336, Apr. 28, 2017, 5 pages.
Grunebaum, et al., "Recent Advances in Understanding and Managing Adenosine Deaminase and Purine Nucleoside Phosphorylase Deficiencie", Current Opinion in Allergy and Clinical Immunology, vol. 13, No. 6, Dec. 2013, 630-638.
Grunewald, et al., "Transcriptome-Wide Off-Target RNA Editing Induced by CRISPR-Guided DNA Base Editors", Nature, vol. 569, 2019, 433-437.
Harris, et al., "RNA Editing Enzyme APOBEC1 and Some of Its Homologs Can Act as DNA Mutators", Molecular Cell, vol. 10, Issue 5, Nov. 2002, 1247-1253.
Jiang, et al., "RNA-Guided Editing of Bacterial Genomes Using CRISPR-Cas Systems", Nature Biotechnology, vol. 31, No. 3, Mar. 2013, 233-239.
Jin, et al., "Cytosine, but Not Adenine, Base Editors Induce Genome-Wide Off-Target Mutations in Rice", Science, vol. 364, No. 6437, 2019, 292-295.
Katrekar, et al., "In Vivo RNA Editing of Point Mutations Via RNA-Guided Adenosine Deaminases", Nature Method, vol. 16, Mar. 2019, 239-242.
Kim, et al., "Increasing the Genome-Targeting Scope and Precision of Base Editing with Engineered Cas9-Cytidine Deaminase Fusions", Nature Biotechnology, vol. 35, No. 4, Feb. 13, 2017, 371-376.
Kim, et al., "Structural and Kinetic Characterization of *Escherichia Coli* tAdA, The Wobble-Specific tRNA Deaminase", Biochemistry, vol. 45, No. 20, May 1, 2006, 6407-6416.
Knott, et al., "Guide-Bound Structures of an RNA-Targeting A-Cleaving CRISPR-Cas13a Enzyme", Nature Structural & Molecular Biology, vol. 24, No. 10, Oct. 2017, 825-833.
Komor, et al., "Programmable Editing of a Target Base in Genomic DNA without Double-Stranded DNA Cleavage", Nature, vol. 533, No. 7603, May 19, 2016, 420-424.
Konermann, et al., "Genome-Scale Transcriptional Activation by an Engineered CRISPR-Cas9 Complex", Nature, vol. 517, No. 7536, Jan. 29, 2015, 583-588.
Konermann, et al., "Transcriptome Engineering with RNA-Targeting Type VI-D CRISPR Effectors", Cell, vol. 173, No. 3, 2018, 665-676.
Kumar, et al., "Dicer 1 Functions as a Haploinsufficient Tumor Suppressor", Genes and Development, vol. 23, No. 23, Dec. 1, 2009, 2700-2704.
Liu, et al., "The Molecular Architecture for RNA-Guided RNA Cleavage by Cas13a", Cell, vol. 170, No. 4, 2017, 714-726.
Macbeth, et al., "Inositol Hexakisphosphate Is Bound in the ADAR2 Core and Required for RNA Editing", Science, vol. 309, No. 5740, Sep. 2005, 1534-1539.
Mackay, et al., "The Prospects for Designer Single-Stranded RNA-Binding Proteins", Nature Structural & Molecular Biology, vol. 18, No. 3, Mar. 2011, 256-261.
Maynard-Smith, et al., "A Directed Approach for Engineering Conditional Protein Stability Using Biologically Silent Small Molecules", The Journal Of Biological Chemistry, vol. 282, No. 34, Aug. 24, 2007, 24866-24872.
Merkle, et al., "Precise RNA Editing by Recruiting Endogenous ADARs with Antisense Oligonucleotides", Nature Biotechnology, vol. 37, 2019, 133-138.
Miyazaki, et al., "Destabilizing Domains Derived from the Human Estrogen Receptor", Journal of the American Chemical Society, vol. 134, No. 9, Mar. 7, 2012, 3942-3945.
Nelles, et al., "Applications of Cas9 as an RNA-Programmed RNA-Binding Protein", Bioessays, vol. 37, Jul. 2015, 1-8.
Nishimasu, et al., "Crystal Structure of Cas9 in Complex with Guide RNA and Target DNA", Cell, vol. 156, Feb. 27, 2014, 935-949.
Nishimasu, et al., "Crystal Structure of *Staphylococcus aureus* Cas9", Cell, vol. 162, No. 5, Aug. 27, 2015, 24 pages.
Platt, et al., "CRISPR-Cas9 Knockin Mice for Genome Editing and Cancer Modeling", Cell, vol. 159, No. 2, Oct. 9, 2014, 31 pages.
Ramakrishna, et al., "Gene Disruption by Cell-Penetrating Peptide-Mediated Delivery of Cas9 Protein and Guide RNA", Genome Research, vol. 24, No. 6, Jun. 2014, 1020-1027.
Ran, et al., "In Vivo Genome Editing using *Staphylococcus aureus* Cas9", Nature, vol. 520, No. 7546, Apr. 1, 2015, 30 pages.
Rees, et al., "Base Editing: Precision Chemistry on The Genome and Transcriptome of Living Cells", Nature Reviews Genetics, vol. 19, No. 12, Dec. 2018, 770-788.
Rodriguez, et al., "Targeted Chemical-Genetic Regulation of Protein Stability In Vivo", Chemistry & Biology, vol. 19, No. 3, Mar. 23, 2012, 391-398.
Schneider, et al., "Optimal Guidernas for Re-Directing Deaminase Activity of hADAR1 and hADAR2 in Trans", Nucleic Acids Research, vol. 42, Issue 10, Apr. 17, 2014, 9 pages.
Shmakov, et al., "Discovery and Functional Characterization of Diverse Class 2 CRISPR-Cas Systems", Molecular Cell, vol. 60, Nov. 5, 2015, 1-13.
Shmakov, et al., "Diversity and Evolution of Class 2 CRISPR-Cas Systems", Nature Reviews Microbiology, vol. 15, No. 3, Mar. 2017, 30 pages.
Slaymaker, et al., "Rationally Engineered Cas9 Nucleases with Improved Specificity", Science, vol. 351, No. 6268, Jan. 1, 2016, 84-88.
Smargon, et al., "Cas13b Is a Type VI-B CRISPR-Associated RNA-Guided RNase Differentially Regulated by Accessory Proteins Csx27 and Csx28", Molecular Cell, vol. 65, No. 4, Feb. 16, 2017, 30 pages.
Svitashev, et al., "Targeted Mutagenesis, Precise Gene Editing, and Site-Specific Gene Insertion in Maize Using Cas9 and Guide RNA", Plant Physiology, vol. 169, No. 2, Oct. 2015, 931-945.

(56) References Cited

OTHER PUBLICATIONS

Veeman, "Zebrafish Prickle, a Modulator of Noncanonical Wnt/Fz Signaling, Regulates Gastrulation Movements", Current Biology, vol. 13, Apr. 15, 2003, 680-685.
Vogel, et al., "Efficient and Precise Editing of Endogenous Transcripts with SNAP-Tagged ADARs", Nature Methods, vol. 15, 2018, 535-538.
Vogel, et al., "Improving Site-Directed RNA Editing In Vitro and in Cell Culture by Chemical Modification of the GuideRNA", Angewandte Chemie International Edition, vol. 53, No. 24, Jun. 10, 2014, 6267-6271.
Wang, et al., "A Phenotypic Screen for Functional Mutants of Human Adenosine Deaminase Acting on RNA 1", ACS Chemical Biology, vol. 10, No. 11, Nov. 20, 2015, 20 pages.
Wang, et al., "Probing RNA Recognition by Human ADAR2 using a High-throughput Mutagenesis Method", Nucleic Acids Research, vol. 44, No. 20, Nov. 16, 2016, 9872-9880.
Wolf, et al., "tadA, an Essential tRNA-Specific Adenosine Deaminase from *Escherichia coli*", The EMBO Journal, vol. 21, No. 14, Jul. 15, 2002, 3841-3851.
Wong, et al., "Substrate Recognition by ADAR1 and ADAR2", RNA, vol. 7, No. 6, Jun. 2001, 846-858.
Yamano, et al., "Crystal Structure of Cpf1 in Complex with Guide RNA and Target DNA", Cell, vol. 165, No. 4, May 5, 2016, 23 pages.
Yan, et al., "Cas13d Is a Compact RNA-Targeting Type VI CRISPR Effector Positively Modulated by a WYL-Domain-Containing Accessory Protein", Molecular Cell, vol. 70, No. 2, Apr. 19, 2018, 327-339.
Yang, et al., "PAM-Dependent Target DNA Recognition and Cleavage by C2c1 CRISPR-Cas Endonuclease", Cell, vol. 167, No. 7, Dec. 15, 2016, 1814-1828.
Zuo, et al., "Cytosine Base Editor Generates Substantial Off-Target Single-Nucleotide Variants in Mouse Embryos", Science, vol. 364, No. 6437, 2019, 289-292.
Bass, B., "RNA editing by adenosine deaminases that act on RNA," Annu. Rev. Biochem., vol. 71, Jan. 1, 2002, all enclosed pages cited.
Mizrahi, R. et al., "Nucleoside analog studies indicate mechanistic differences between RNA-editing adenosine deaminases," Nucleic Acids Research, vol. 40, No. 19, Aug. 11, 2012, all enclosed pages cited.
Kuttan, A., et al., "Mechanistic insights into editing-site specificity of ADA," Proceedings of the National Academy of Sciences, vol. 109, No. 48, Nov. 5, 2012, all enclosed pages cited.
Matthews, M. et al., "Structures of human ADAR2 bound to dsRNA reveal base-flipping mechanism and basis for site selectivity," Nat. Struct. Mol. Biol., vol. 23, No. 5, Apr. 11, 2016, all enclosed pages cited.
Zheng, Y., et al., "DNA editing in DNA/RNA hybrids by adenosine deaminases that act on RNA," Nucleic Acids Research, vol. 45, No. 6, Jan. 28, 2017, all enclosed pages cited.
Cox, D., et al., "RNA editing with CRISPR-Cas13," Science, vol. 358, No. 6366, Nov. 24, 2017, all enclosed pages cited.
Anonymous, "RED_1Human," Retrieved from https://www.uniprot.org/uniprot/P78563.txt?version=175 on Oct. 7, 2019, all enclosed pages cited.
Invitation to Pay Additional Fees for International Application No. PCT/US2019/044480 mailed Dec. 5, 2019, all enclosed pages cited.
International Search Report and Written Opinion for International Application No. PCT/US2019/044480 mailed Feb. 3, 2020, all enclosed pages cited.
Chapter I IPRP for International Application No. PCT/US2019/044480 mailed Feb. 2, 2021, all enclosed pages cited.
Partial Search report for corresponding European application No. 19758543.3 mailed Apr. 11, 2022. all enclosed pages cited.
The Broad Institute, Inc., "Communication pursuant to Rule 164(2)(b) and Article 94(3) EPC for EP 19758543.3", Aug. 8, 2022, 12 pages.
Muzny, "Uncharacterized Protein from Prevotella Buccae", retrieved from internet, http://rest.uniprot.org/unisave/E6K398?format=txt&versions=14, Nov. 28, 2018, 2 pages.
Myhrvold, et al., "Field-deployable Viral Diagnostics using CRISPR-Cas13", Science, vol. 360, No. 6387, Apr. 27, 2018, pp. 444-448.
The Broad Institute, Inc., "Office Action for Russian Patent Application No. 2021105208", Mar. 30, 2023, 17 pages.
Smirnov, et al., "CRISPR/Cas9, a universal tool for genomic engineering", Journal of Genetics and Breeding. 2016;20 (4):493-510—English abstract.
The Broad Institute, Inc., "Notification of the First Office Action for Chinese Patent Application No. 201980064619X", Feb. 8, 2024, 19 pages.
The Broad Institute, Inc., Communication pursuant to Article 94(3) EPC for European Patent Application No. 19758543.3, 5 pages, Jun. 26, 2025.
The Broad Institute, Inc., Notice of Grounds for Rejection for Korean Patent Application No. 10-2021-7006313, 12 pages, Oct. 28, 2025.

* cited by examiner apo ······ guide-bound ········ guide-target ~~~~ guide-bound + non-complementary RNA ······ guide-bound + Mg²⁺ ······ guide-target ······ guide-target + Mg²⁺ apo ······ apo + Mg²⁺ ······ guide-bound ⎯⎯ guide-bound + Mg²⁺

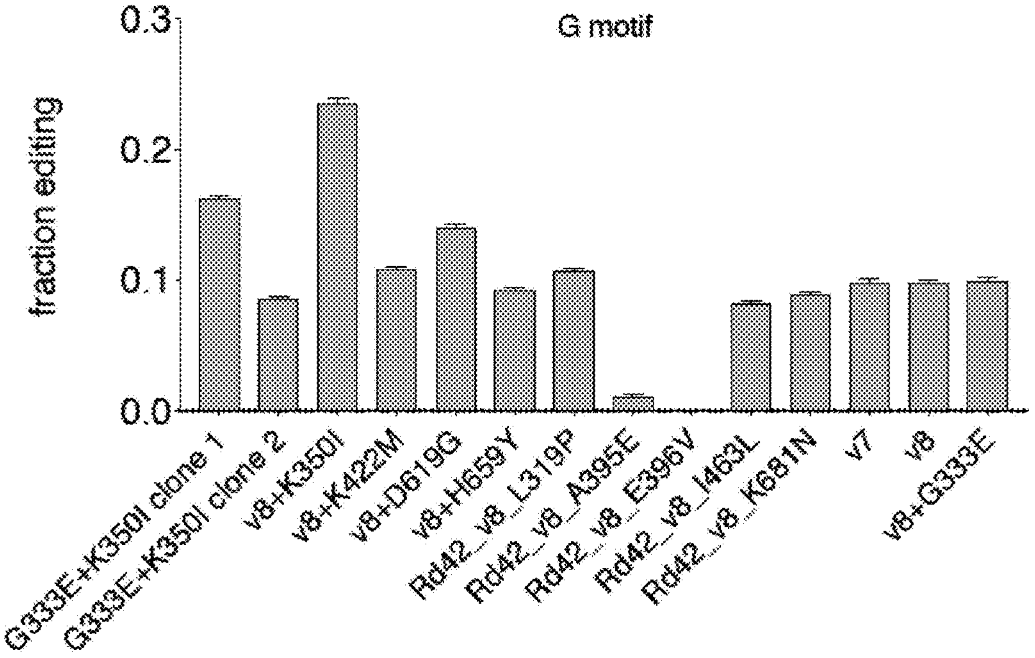
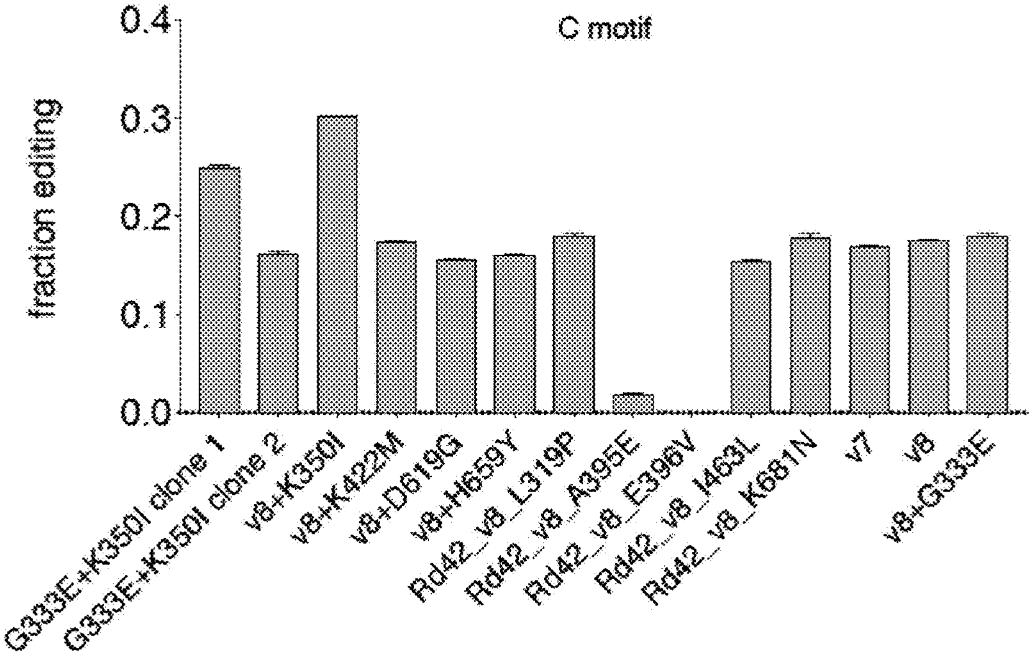
FIG 23B

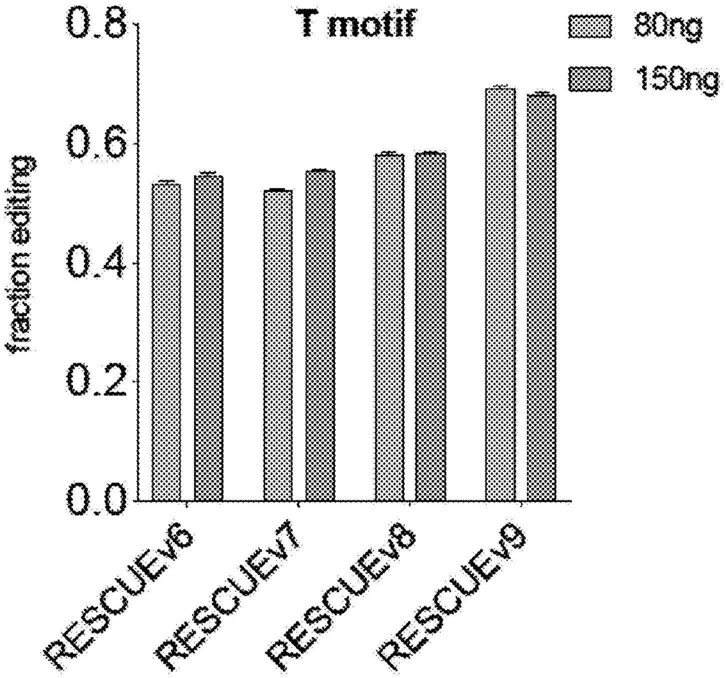
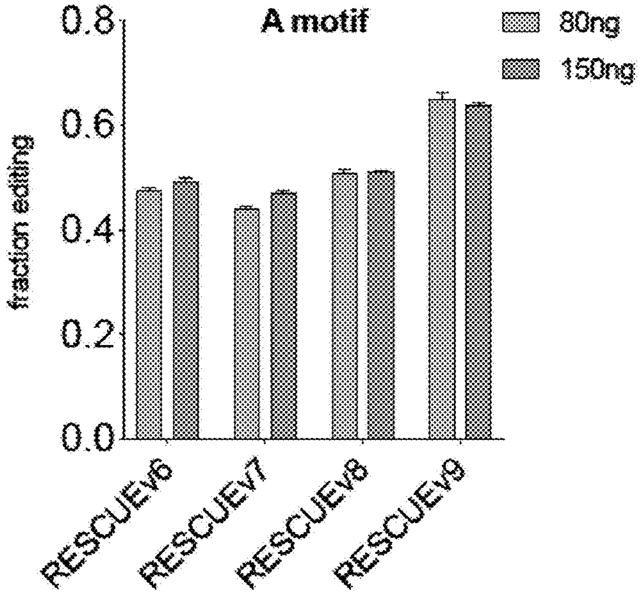
FIG 24A

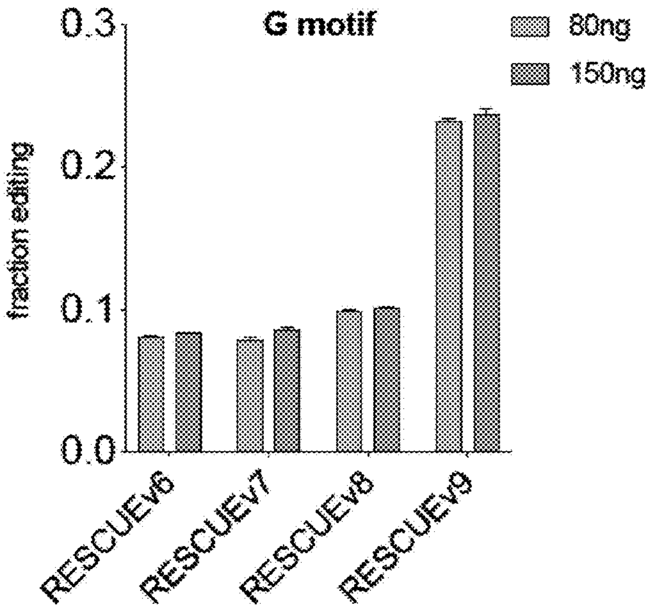
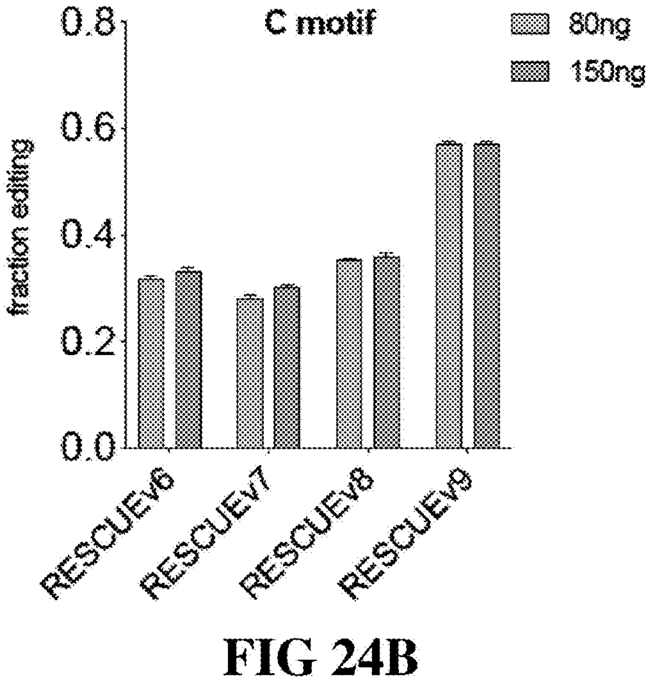
FIG 24B

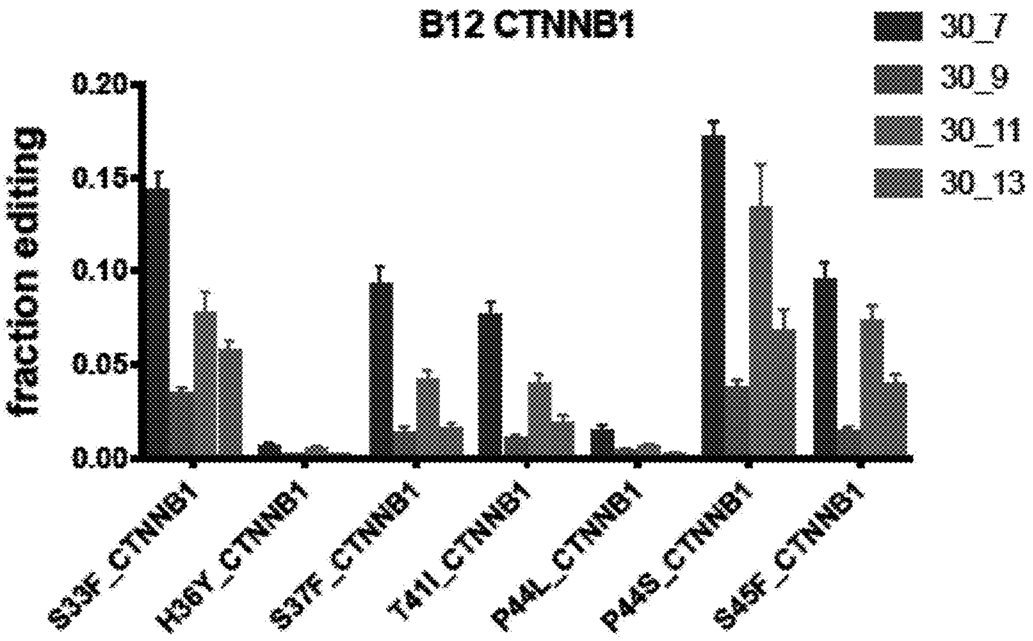
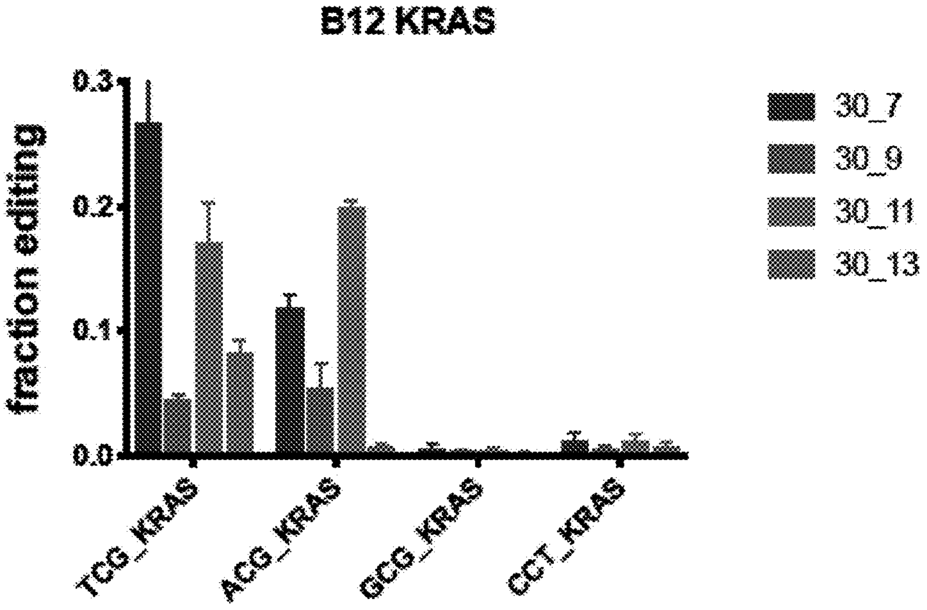
FIG 30B

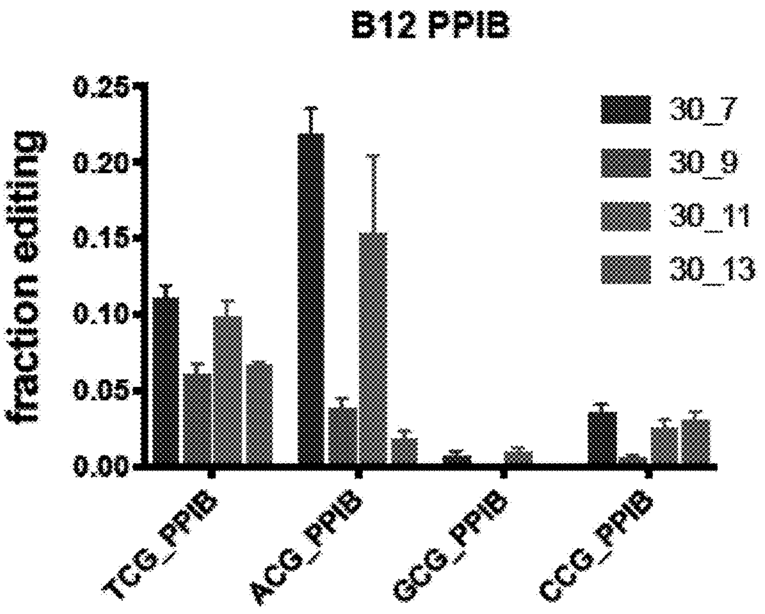
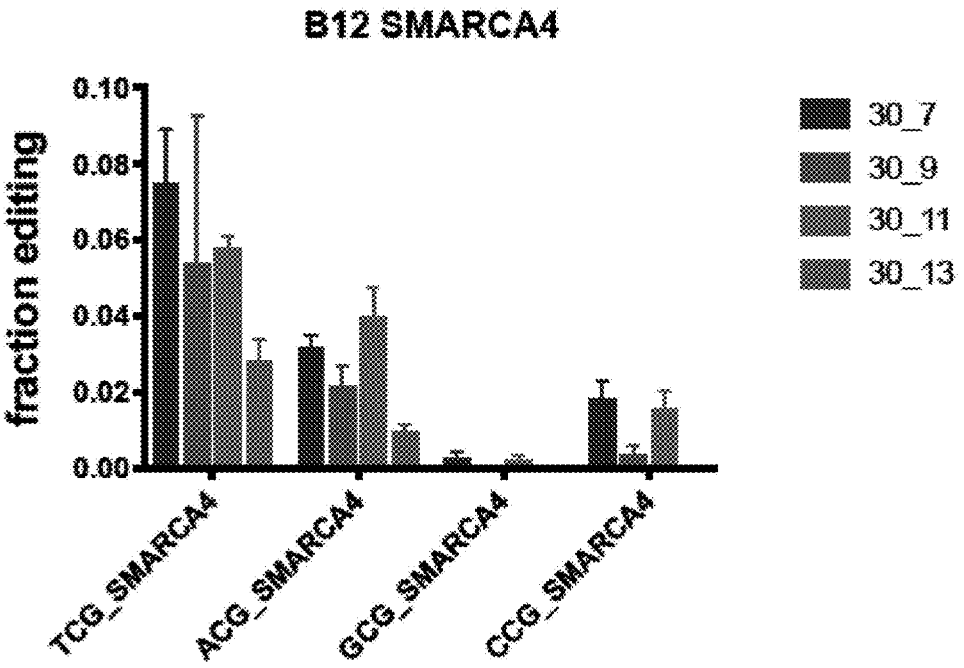
FIG 30D

*ADE2 W185X:* Targeting

5'-CGGAAGCTTTGGAAGTACTGAAGGATCGTCCTTTGTACGCCGAAAAATGAGCACCATTTACTAAAGAATTAGCAGTCATG-3'

W185X

*URA3 A116A:* Off-target

5'-AATACAGTCAAATTGCAGTACTCTGCGGGTGTATACAGAATAGCAGAATAGGCAGACATTACGAATGCACACGGTGTGGT-3'

| | editing rate |
|---|---|
| R square | 0.5095 |

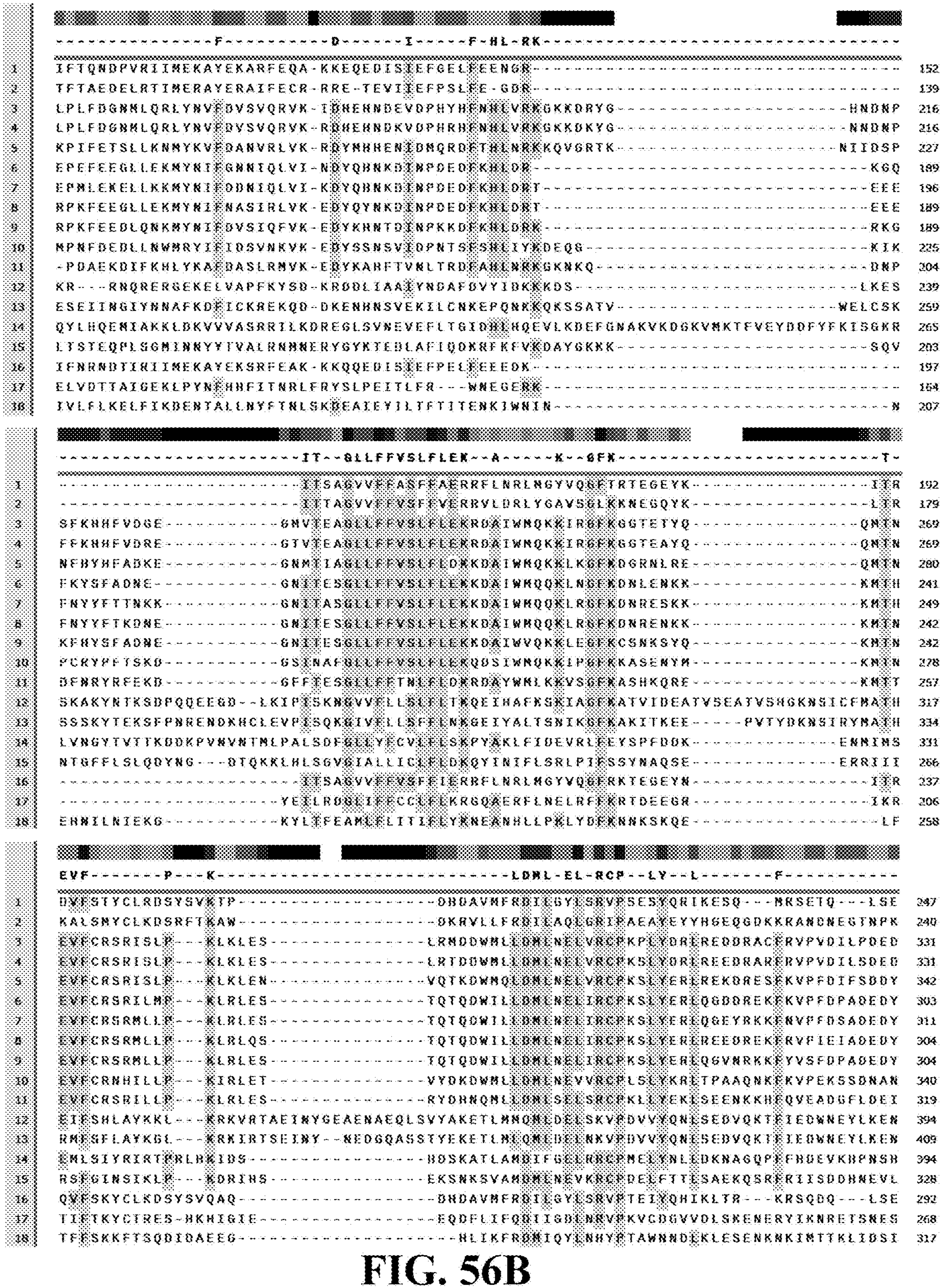

FIG. 56B

```
- - - - - - - - - - - - - F - - - - - - - - - - D - - - - - - I - - - - - F - HL - RK - - - - - - - - - - - - - - - - - - - - - - - - - - - -
1   IFTQNDPVRIIMEKAYEKARFEQA-KKEQEDISIEFGELFEENGR- - - - - - - - - - - - - - - - - - - - - - - - - - - - - - - - - -       152
2   TFTAEDELRTIMERAYERAIFECR-RRE-TEVIIEFPSLFE-GDR- - - - - - - - - - - - - - - - - - - - - - - - - - - - - - - - - -       139
3   LPLFDGNMLQRLYNVEDVSVQRVK-IDHEHNDEVDPHYHFNHLVRKGKKDRYG- - - - - - - - - - - - - - - - - - - - HNDNP       216
4   LPLFDGNMLQRLYNVEDVSVQRVK-RDHEHNDKVDPHRHFNHLVRKGKKDKYG- - - - - - - - - - - - - - - - - - - - NNDNP       216
5   KPIFETSLLKNMYKVEDANVRLVK-RDYNHHENIDMQRDFTHLNRKKQVGRTK- - - - - - - - - - - - - - - - - - - - NIIDSP       227
6   EPEFEEGLLEKMYNIFGNNIQLVI-NDYQBNKDINPDEDFKHLDR- - - - - - - - - - - - - - - - - - - - - - - - - - - - - KGQ       189
7   EPMLEKELLKKMYNIFODNIQLVI-KDYQBNKDINPDEDFKHLDRT- - - - - - - - - - - - - - - - - - - - - - - - - - - - EEE       196
8   RPKFEEGLLEKMYNIFNASIRLVK-EDYQYNKDINPDEDFKHLDRT- - - - - - - - - - - - - - - - - - - - - - - - - - - - EEE       189
9   RPKFEEDLQNKMYNIFDVSIQFVK-EDYKHNTDINPKKDFKHLDRK- - - - - - - - - - - - - - - - - - - - - - - - - - - - RKG       189
10  MPNFDEDLLNWMRYIEIDSVNKVK-EDYSSNSVIDPNTSFSHLIYKDEQG- - - - - - - - - - - - - - - - - - - - - - - - - KIK       225
11  -PDAEKDIFKHLYKAFDASLRMVK-EDYKAHFTVNLTRDFAHLNRKGKNKQ- - - - - - - - - - - - - - - - - - - - - - - DNP       304
12  KR- - - -RNQRERGEKELVAPFKYSD-KRDDLIAAIYNDAFDVYIDKKKDS- - - - - - - - - - - - - - - - - - - - - - - - LKES       239
13  ESEIINGIYNNAFKDFICKREKQD-DKENHNSVEKILCNKEPQNKKQKSSATV- - - - - - - - - - - - - - - - - - - - WELCSK       259
14  QYLHQENIAKKLDKVVVASRRILKDREGLSVNEVEFLTGIODHLHQEVLKDEFGNAKVKDGKVMKTFVEYDDFYFKISGKR       265
15  LTSTEQPLSGMINNYYTVALRNHNERYGYKTEBLAFIQDKRFKFVKDAYGKKK- - - - - - - - - - - - - - - - - - - - SQV       203
16  IFNRNDTIRIIMEKAYEKSRFEAK-KKQQEDISIEFPELFEEEDK- - - - - - - - - - - - - - - - - - - - - - - - - - - - -       197
17  ELVDTTAIGEKLPYNFHHFITNRLFRYSLPEITLFR- - -WNEGERK- - - - - - - - - - - - - - - - - - - - - - - - - - -       164
18  IVLFLKELFIKDENTALLNYFTNLSKDEAIEYILTFTITENKIWNIN- - - - - - - - - - - - - - - - - - - - - - - - - - - N       207

- - - - - - - - - - - - - - - - - - - - - - - - IT - - GLLFFVSLFLEK - - A - - - - - K - - GFK - - - - - - - - - - - - - - - - - - - T -
1   - - - - - - - - - - - - - - - - - - - - - - - - IISAGVVFFASFFAERRFLNRLNGYVQBFTRTEGEYK- - - - - - - - - - - - - - - IIR       192
2   - - - - - - - - - - - - - - - - - - - - - - - - IITAGVVFFVSFFVERRVLDRLYGAVSGLKKNEGQYK- - - - - - - - - - - - - - - LIR       179
3   SFKHHFVDGE- - - - - - - - - - - - -GNVIEABLLFFVSLFLEKRDAIWNQKKIRBFKGGTETYQ- - - - - - - - - - - - - - - QNIN       269
4   FFKHHFVDRE- - - - - - - - - - - - -GTVIEABLLFFVSLFLEKRDAIWNQKKIRBFKGGTEAYQ- - - - - - - - - - - - - - - QNIN       269
5   NFHYHFABKE- - - - - - - - - - - - -GNMIABLLFFVSLFLDKKDAIWHQKKLKGFKDGRNLRE- - - - - - - - - - - - - - - QMIN       280
6   FKYSFADNE- - - - - - - - - - - - - -GNIESGLLFFVSLFLEKKDAIWHQQKLNGFKDNLENKK- - - - - - - - - - - - - - - KMIH       241
7   FNYYFTTNKK- - - - - - - - - - - - -GNIIASGLLFFVSLFLEKKDAIWHQQKLRGFKDNRESKK- - - - - - - - - - - - - - - KMIH       249
8   FNYYFTKDNE- - - - - - - - - - - - -GNIIESGLLFFVSLFLEKKDAIWHQQKLRGFKDNRENKK- - - - - - - - - - - - - - - KMIN       242
9   KFHYSFADNE- - - - - - - - - - - - -GNIIESGLLFFVSLFLEKKDAIWVQKKLEGFKCSNKSYQ- - - - - - - - - - - - - - - KMIN       242
10  PCRYPFTSKD- - - - - - - - - - - - -GSINAFGLLFFVSLFLERQDSIWNQKKIPBFKKASENYM- - - - - - - - - - - - - - - KMIN       278
11  DFNRYRFEKD- - - - - - - - - - - - -GFFIESGLLFFTNLFLDKRRDAYWNLKKVSGFKASHKQRE- - - - - - - - - - - - - - - KMIT       257
12  SKAKYNTKSDPQQEEGD- -LKIPISKNGVFLLSLFLIKQEIHAFKSKIAGFKATVIDEATVSEATVSHGKNSICFMAIH       317
13  SSSKYTEKSFPNRENDXHCLEVPISQKGIVFLLSFFLNKGEIYALTSNIKGFKAKITKEE- - - - -PVTYDKNSIRYMAIH       334
14  LVNGYTVTIKDDKPVNVNTMLPALSDFGLLYFCVLFLSKPYAKLFIDEVRLFEYSPFDDK- - - - - - - - -ENNINS       331
15  NTGFFLSLQDYNG- - - -DTQKKLHLSGVGIALLICLFLDKQYINIFLSRLPIFSSYNAQSE- - - - - - - - - - -ERRIII       266
16  - - - - - - - - - - - - - - - - - - - - - - - - IISAGVVFFVSFFIERRFLNRLMGYVQBFRKTEGEYN- - - - - - - - - - - - - - - IIR       237
17  - - - - - - - - - - - - - - - - - - - - - - - - YEILRDQLIFCCLFLKRGQAERFLNELRFFKRTDEEGR- - - - - - - - - - - - - - - IKR       206
18  EHNILNIEKG- - - - - - - - - - - - -KYLTFEAMLFLITIFLYRNEANHLLPKLYDFKNNKSKQE- - - - - - - - - - - - - - - LF       258

EVF- - - - - - - -P- - -K- - - - - - - - - - - - - - - - - - - - - - - - - - - - - -LDML-EL-RCP- -LY- -L- - - - - - - -F- - - - - - - - - - -
1   DVFSTYCLRDSYSVKTP- - - - - - - - - - - - - - - - - - - -DHDAVMFRDILGYISRVPSESYQRIKESQ- - -MRSETQ- - -LSE       247
2   KALSMYCLKDSRFTKAW- - - - - - - - - - - - - - - - - - - -DKRVLLFRDILAQLGRIPAEAYEYYHGEQGDKKRANCNEGTNPK       240
3   EVFCRSRISLP- - -KLKLES- - - - - - - - - -D- - - - - - - - -LRMDDWMLLDMLNELVRCPKPLYDRLREDDRACFRVPVDILPDED       331
4   EVFCRSRISLP- - -KLKLES- - - - - - - - - - - - - - - - - - -LRTDDWMLLDMLNELVRCPKSLYDRLREEDRARFRVPVDILSDED       331
5   EVFCRSRISLP- - -KLKLEN- - - - - - - - - - - - - - - - -VQTKDWMQLDMLNELVRCPKSLYERLREKDRESFKVPFDIFSDDY       342
6   EVFCRSRILMP- - -KLRLES- - - - - - - - - - - - - - - - -TQTQDWILLDMLNELIRCPKSLYERLQGDDREKFKVPFDPADEDY       303
7   EVFCRSRMLLP- - -KLRLES- - - - - - - - - - - - - - - - -TQTQDWILLDMLNELIRCPKSLYERLQGEYRKKFNVPFDSADEDY       311
8   EVFCRSRMLLP- - -KLRLQS- - - - - - - - - - - - - - - - -TQTQDWILLDMLNELIRCPKSLYERLREEDREKFRVPFIEIADEDY       304
9   EVFCRSRMLLP- - -KLRLES- - - - - - - - - - - - - - - - -TQTQDWILLDMLNELIRCPKSLYERLQGVNRKKFYVSFDPADEDY       304
10  EVFCRNHILLP- - -KIRLET- - - - - - - - - - - - - - - -VYDKDWMLLDMLNEVVRCPLSLYKRLTPAAQNKFKVPEKSSDNAN       340
11  EVFCRSRILLP- - -KLRLES- - - - - - - - - -RYDHNQMLLDMISELSRCPKLLYEKLSEENKKHFQVEADGFLDEI       319
12  EIFSHLAYKKL- - -RRKVRTAEINYGEAENAEQLSVYAKETLMNQMLDELSKVFDVVYQNLSEDVQKTFIEDWNEYLKEN       394
13  RMFSFLAYKGL- - -RRKIRTSEINY- -NEDGQASSTYEKETLNLQMLDELNKVFDVVYQNLSEDVQKTFIEDWNEYLKEN       409
14  EMLSIYRIRTPRLHKIDS- - - - - - - - - - - - - - -HDSKATLAMDIFGELRBCPMELYNLLDKNAGQPFFHDEVKHPNSH       394
15  RSFGINSIKLP- - -KDRIHS- - - - - - - - - - - - - - -EKSNKSVAHDMLNEVKRCPDELFTTLSAEKQSRFRIISDDHNEVL       328
16  QVFSKYCLKDSYSVQAQ- - - - - - - - - - - - - - - -DHDAVMFRDILGYISRVPTEIYQHIKLTR- - -KRSQDQ- - -LSE       292
17  TIFTKYCTRES-HKHIGIE- - - - - - - - - - - - - - -EQDFLIFQDIIGDINRVPKVCDGVVDLSKENERYIKNRETSNES       268
18  TFFSKKFTSQDIDAEEG- - - - - - - - - - - - - - - - -HLIKFRDNIQYLNHYFTAWNNDLKLESENKNKIMTTKLIDSI       317
```

```
   -----------F---L-R----DRFPYFALRY-D----F--LRFQ--LG-YH---Y-K---I------RH----L-GF-R
1  RKT-------------------DKFILFALNYLEDYGLEDLADYTACFARTRIKREQD----ENTDGKEQKPHRKK----  300
2  RHK-------------------DKFIEFALHYLEAQ------HSEICFGRRHIVREEAG------AGDEHKKHRTK----  285
3  DTDG--GGEDPFKNTLVR--HQDRFPYFALRYFDLKKVFTSLRFHIDLGTYHFAIYKKM--IGEQPEDRHLTRNLYGFGR  405
4  DTDG--TEEDPFKNTLVR--HQDRFPYFALRYFDLKKVFTSLRFHIDLGTYHFAIYKKN--IGEQPEDRHLTRNLYGFGR  405
5  NAE-----EEPFKNTLVR--HQDRFPYFVLRYFDLNEIFEQLRFQIDLGTYHFSIYNKR--IGDEDEVRHLTHHLYGFAR  413
6  NAE-----QEPFKNTLIR--HQDRFPYFVLRYFDYNEIFKNLRFQIDLGTYHFSIYKKL--IGGQKEDRHLTHKLYGFER  374
7  DAE-----QEPFKNTLVR--HQDRFPYFALRYFDYNEIFTNLRFQIDLGTYHFSIYKKL--IGGQKEDRHLTHKLYGFER  382
8  DAE-----QEPFKNTLVR--HQDRFPYFALRYFDYNEIFTNLRFQIDLGTYHFSTYKKQ--IGDYKESHHLTHKLYGFER  375
9  DAE-----QEPFKNTLVR--HQDRFPYFALRYFDYNEVFANLRFQIDLGTYHFSIYKKL--IGGQKEDRHLTHKLYGFER  375
10 RQE----DDNPFSRILVR--HQNRFPYFVLRFFDLNEVFTTLRFQINLGCYHFAICKKQ--IGDKKEVHHLIRTLYGFSR  412
11 EEE-----QNPFKDTLIR--HQDRFPYFALRYLDLNESFKSIRFQVDLGTYHYCIYDKK--IGDEQEKRHLTRTLLSFGR  390
12 NGDVGTMEEEQVIHPVIRKRYEDKFNYFAIRFLDEFAQFPTLRFQVHLGNYLHDSRPKE----NLISDRRIKEKITVFGR  470
13 NGDVGTMEEEQVIHPVIRKRYEDKFNYFAIRFLDEFAQFPTLRFQVHLGNYLCDKRTKQ--ICDTTTEREVKKKITVFGR  487
14 TPD-----------VSKRLRYDDRFPTLALRYIDETELFKRIRFQLQLGSFRYKFYDKENCIDGRVRVRRIQKEINGYGR  463
15 MKR-----------------SSDRFVPLLLQYIDYGKLFDHIRFHVNMGKLRYLLKADKTCIDGQTRVRVIEQPLNGFGR  391
16 RKT-------------------DKFILFALKYLEDYGLKDLADYTACFARSKIKRENED--TKETDGNKHKFHREK----  347
17 DEN------KARYRLLIR--EKDKFPYYLMRYIVDFGVLPCITFKQNDYSTKEGRGQFHYQDAAVAQEERCYNFVVRNG-  339
18 IEFELNSNYPSFATDIQFKKEAKAFLFASNKKRNQTSFSNKSYNEEIRHNPHIKQYRDEIASALTPISFNVKEDKFKIFV  397

   -Q--------------------------E----------------------PYI--T-PHY--E--KIG-----------
1  ------------------PRVEIHFERAEGDP----------------------------FYIKHNNVILRIQ-------  327
2  ------------------GKVVVDFSKKDEDQS---------------------------YYISKNNVIVRID-------  313
3  IQDFAEEHRPEE-----WKRLVRDLDYFETGDK------------------PYISQTSPHYHIEKGKIGLRFN----PEG  458
4  IQDFAEEHRPEE-----WKRLVRDLDYFETGDK------------------PYITQTTPHYHIEKGKIGLRFV----PEG  458
5  IQDFAPQNQPEE-----WRKLVKDLDHFETSQE------------------PYISKTAPHYHLENEKIGIKFC----SAH  466
6  IQEFAKQNRPDE-----WKAIVKDLDTYETSNK------------------RYISETTPHYHLENQKIGIRFR----NGN  427
7  IQEFAKQNRTDE-----WKAIVKDFDTYETSEE------------------PYISETAPHYHLENQKIGIRFR----NDN  435
8  IQEFTKQNRPDE-----WRKFVKTFNSFETSKE------------------PYIPETTPHYHLENQKIGIRFR----NDN  428
9  IQEFDKQNRPDE-----WKAIVKDSDTFKKKEEKEEE-------------KPYISETTPHYHLENKKIGIAFK----NHN  433
10 LQNFTQNTRPEE-----WNTLVKTTEPSSGNDGKTVQG----------VPLPYISYTIPHYQIENEKIGIKIFDGDTAVD  477
11 LQDFTEINRPQE-----WKALTKDLDYKETSNQ------------------PFISKTTPHYHITDNKIGFRLG-----TS  442
12 LSELEHKK----------ALFIKNTETNEDREH------------------YWEIFPNPNYDFPKENISVNDK------D  516
13 LSELENKK----------AIFLNEREEIKG----------------------WEVFPNPSYDFPKENISVNYK------D  529
14 MQEVADKRMDKW-----GDLIQKREERSVKLEHEELYINLDQFLEDTADSTFYVTDRRPAYNIHANRIGLYWEDSQNPKQ  538
15 LEEAETMRKQENGTFGNSGIRIRDFENMKRDDANPAN-------------YPYIVDTYTHYILENNKVEMFIND------  452
16 ------------------PVVEIHFDKEKQDQ----------------------------FYIKRNNVILKAQ-------  374
17 ------------------NVYYSYNPQAQNVVR--------------------ISELQGTISVEELRNMVYAS-------  374
18 KKHVLEEYFPNSIG---YEKFLEYNDFIEKEKE--------------------DFGLKLYSNPKTNKLIERION------  448

   -------S-----------KY-------AE--LSV-EL--M-FY--L-----------------------------E--I
1  --------------KKGAQTYIFRMGVYELKYLVLLSLLGKG----------------------------------AEAV  359
2  --------------KNAGPR-SYRMGLNELKYLVLLSLQGKG----------------------------------DDAI  344
3  QHLWP--SPEVGTTRTGRSKYAQDKRLTAEAFLSVHELMPMMFYYFLLREKYSEEV---------------SAERVQGRI  521
4  QHLWP--SPEVGATRTGRSKYAQDKRLTAEAFLSVHELMPMMFYYFLLREKYSEEV---------------SAEKVQGRI  521
5  NNLFP--SLQTDKTCNGRSKFNLGTQFTAEAFLSVHELLPMMFYYLLLTKDYSRKE---------------SADKVEGII  529
6  KEIWP--SLKTNDENNEKSKYKLDKQYQAEAFLSVHELLPMMFYYLLLKKEKPNND-------------EINASIVEGFI  492
7  DEIWP--SLKTNGENNEKRKYKLDKQYQAEAFLSVHELLPMMFYYLLLKKEEPNND-------------KKNASIVEGFI  500
8  DKIWP--SLKTNSEKNEKSKYKLDKSFQAEAFLSVHELLPMMFYYLLLKTENTDNDNEIETKKKENKNDKQEKHKIEEII  506
9  --IWP--STQTELTNNKRKKYNLGTSIKAEAFLSVHELLPMMFYYLLLKTENTKNDNKVGGKK---ETKKQGKHKIEAII  506
10 TDIWP--SVSTEKQLNKPDKYTLTPGFKADVFLSVHELLPMMFYYQLLLCEGNLKT--------------DAGNAVEKVL  541
11 KELYP--SLEIKDGANRIAKYPYNSGFVAHAFISVHELLPLMFYQHLTGKS-------------------------EDLL  495
12 FPIAG--SILDREKQPVAGKIGIKVKLLNQQYVSEVDKAVKAHQLKQ---RKASKFSIQN--IIEEIVPINESNPKEAIV  589
13 FPIVG--SILDREKQPVSNKIGIRVKIADELQR-EIDKAIKEKKLRNPKNRKANQDEKQKERLVNEIVSTNSNEQGEPVV  606
14 YKVFDENGMYIPELVVTEDKKAPIKMPAPRCALSVYDLPAMLFYEYLREQQDNEFP------------------SAEQVI  600
15 -------KEDSAPLLPVIEDDRYVVKTIPSCRMSTLEIPAMAFHMFLFGSK-----------------------KTEKLI  502
16 --------------KKGGQSNVFRMGVYELKYLVLLSLLGKA----------------------------------EEAI  406
17 ---------INGKDVNKSVEQYLYHLHLLYEKILTISGQTIKE-------------------------------------G  409
18 ------HKLVKSHGRNQDRFMDFSMRFLAENNYFGKDAFFKCYKFYDTQEQDEFLQ--------------SNENNDVKFH  509
```

FIG. 56C

```
   ----L-----------L-----------LV---K-----LP-G-FT--------------------------V-------
1  ----LGREELKEYVGLIPKEEKEVSFEEKTDRVVK---------------------------------------------  547
2  ----IGDQKLYDYVGLGKKD--EIDYKQKVAWFKE---------------------------------------------  526
3  ----IGRSDRVENRPFELLKEPKTDRQTLVAGWKG-EFHLPRGIFTEAVRDCLIENG------HDEVASYKEVGFMAKAV  786
4  ----IGRSDRVENHRFELLKEPKTDRQTLVAGWKG-EFHLPRGIFTEAVRDCLIENG------YDEVGSYKEVGFMAKAV  786
5  ----LKPQNWKQYQHFEILKVQKTNRNTLVTGWKN-SFNLPRGIFTQPIREWFEKHNNSKR-IYDQILSFDRVGFVAKAI  799
6  ----LKPEDWKKNQYFEKLKEPKTNRETLVQGWKN-GFNLPRGIFTEPIREWFKRHQNNSK-EYEKVEALDRVGLVTKVI  761
7  ----LKPEDWEKNQYFLKLKEPKTNRETLVQGWKN-GFNLPRGIFTEPIREWFKRHQNDSE-EYEKVETLDRVGLVTKVI  769
8  ----LKPEDWEKNQYFLKLKEPKTKPKTLVQGWKN-GFNLPRGIFTEPIRKWFMKHREN-----ITVAELKRVGLVAKVI  772
9  ----LKPEDWEKNQYFLMLKEPKTNRETLVQGWKN-GFNLPRGFFTEPIRKWFMEHWKS-----IKVDDLKRVGLVAKVT  772
10 ----LQPQNWASDNYFELLRAPKNDRQKLAEGWKN-GFNLPRGLFTEKIKTWFNEHKTIVD-ISDCDIFKNRVGQVARLI  812
11 ----IKNQPWEPYQYCELLKIPKENRKNLVKGWEQGGISLPRGLFTEAIRETLSEDLMLSKPIRKEIKKHGRVGFISRAI  766
12 ----LPEKVFQHLPFKLGGYFQQKYLYQFYTCYLDKRLEYISGLVQQ-AENFKSENKVFKKVENECFKFLKKQNYTHKEL  874
13 ----LPKEVFKHFPFKLKGYFQQQYLNQFYTDYLKRRLSYVNELLLN-IQNFKNDKDALKATEKECFKFFRKQNYIINPI  842
14 SDKALSALPFIHHDRMRYHERTSEENMALAARYTT--IQLPDGLFTPYILEILQKHYTENSDLQNALSQDVPVKLNPTCN  909
15 -----LSNEIKKGNRVDVPFIRRDQNKWKTPAMKTLGRIYSEDLPVELPRQMFDNEIKS---HLKSLPQMEGIDFNNANV  773
16 ----LQSENLKEYIGLIPKEEKEVTFREKVDRILE---------------------------------------------  594
17 ---QLNSIGKGTAKVEAIADHVGLKLYDKLKEYTP-----------------------------EQLEREVKLVVNHGYA  629
18 ---KNKEHEFGHHKNLNITREEFNDYCKWMFAFNG-NDSYKKYLRDLFSEKHFFDNQEYKNLFESSVNLEAFYAKTKELF  790

   -------------------------D--QPFY---F------K--------F----EE----W-----------------
1  ----------------------------QPVIYKGFLRNEFFRESRKS---FARLVEEAVREKGEVYDVPLG--------  588
2  ----------------------------HISIRRGFLRKKFWYDSKKG---FAKLVEEHLESGGGQRDVGLD--------  567
3  PLYFERAC----------------EDRVQPFYDSPFNVGNSLKPKKGR---FLSK-EERAEEWERGKERFRDLEAWSYSA  846
4  PLYFERAS----------------KDRVQPFYDYPFNVGNSLKPKKGR---FLSK-EKRAEEWESGKERFR---------  837
5  PLYFAEEY----------------KDNVQPFYDYPFNIGNRLKPKKRQ---FLDK-KERVELWQKNKELFKN--------  851
6  PLFFKEEYFKDKEENFKEDTQKEINDCVQPFYNFPYNVGNIHKPKEKD---FLHR-EERIELWDKKKDKFKGYKE-----  832
7  PLFFKKEDSKDKEEYLKKDAQKEINNCVQPFYGFPYNVGNIHKPDEKD---FLPS-EERKKLWGDKKYKFKGYKA-----  840
8  PLFFSEEY----------------KDSVQPFYNYHFNVGNINKPDEKN---FLNC-EERRELLRKKKD------------  820
9  PLFFSEKY----------------KDSVQPFYNYPFNVGDVNKPKEED---FLHR-EERIELWDKKKDKFKGYKA-----  827
10 PVFFDKKF----------------KDHSQPFYRYDFNVGNVSKPTEAN---YLSK-GKREELFKSYQNKFKN--------  864
11 TLYFKEKY----------------QDKHQSFYNLSYKL-----EAKAP---LLKR-EEHYEYWQQNKPQSPT--------  813
12 DARVQSIL------------------GYPIELERGEMDEKPTIIKGKT---FKGN-EALFADWFRYYKEYQ---------  923
13 NIQIQSIL------------------VYPIELKRGFLDEKPTMIDREK---FKENKDTELADWFMHYKNYKE--------  893
14 AAYLITLFYQT-----------VLKDNAQPFYLSDKTYTRNKDGEKAESFSFKRAYELFSVLNNNKKDTFPFEMIPLFLT  978
15 TYLIAEYNKR------------VLDDDFQTFYQWNRNYRYNDMLKGEYD--RKGSLQHCFTSVEEREGLWKERAS-----  834
16 ----------------------------QPVVYKGFLRYEFFKEDKKS---FARLVEEAIKTKWSDFDIPLG--------  635
17 AAATPKPK----------------AQAAIPSKLTELRFYSFLGKREMSFAAFIRQDKKAQKLWLRNFYTVEN--------  685
18 KKWIETNKP---------------TNNENRYTLENYKNLILQKQVFINVYHESKYLIDKNLLNSENNVIQYKSLEN----  851

   --------------------------------------------------------------------W-K-E-EL----
1  ---------------------------------------------------------GEYYEIVSLDTFDKDNKRLY--E  609
2  ---------------------------------------------------------KKYYHIDAIGRFEGANPALY--E  588
3  ARRIEDAFAGIEYASPGNKKKIEQLLRDLSLWEAFESKLKVRADRINLAKLKKEILEAQEHPYHDFKSWQKFERELR--L  934
4  -----------------------------------------------LAKLKKEILEAKEHPYHDFKSWQKFERELR--L  868
5  ---------------------------------------------------YPSEKKKTDLAYLDFLSWKKFERELR--L  878
6  ---------------------------------------------KIKSKKLTEKDKEEFRSYLEFQSWNKFERELR--L  865
7  ---------------------------------------------KVKSKKLTDKEKEEYRSYLEFQSWNKFERELR--L  873
8  -----------------------------------------------EFKKMTDKEKEENPSYLEFKSWNKFERELR--L  851
9  ---------------------------------------------KKKFKEMTDKEKEEHRSYLEFQSWNKFERELR--L  860
10 --------------------------------------------------NIPAEKTKEYREYKNFSLWKKFERELR--L  892
11 -----------------------------------------------ESQRLELHTSDRWKDYLLYKRWQHLEKKLR--L  844
12 -----------------------------------------------NFQTFYDTENYPLVELEKKQADRKRKTKIY--Q  954
13 ----------------------------------------------DNYQKFY---AYPLEKVEEKEK-FKRNKQIN--K  921
14 SDEIQERLSAKLLDGDGNP--VPEVGEKGKPATDSQGNTIWKRRIYSEVDDYAEKLTDRDMKISFKGEWEKLPRWKQDKI  1056
15 -----------------------------------------------RTERYRKQASNKIRSNRQMRNASSEEIETILDK  867
16 ---------------------------------------------------------EEYYNIPSLDRFDRTNKKLY--E  656
17 ---------------------------------------------------IKTLQKRQAAADAACKKLYNLVGEVER--  712
18 -----------------------------------------------VEYLISDFYFQSKLSIDQYKTCGKLFNKLK--S  882
```

FIG. 56E

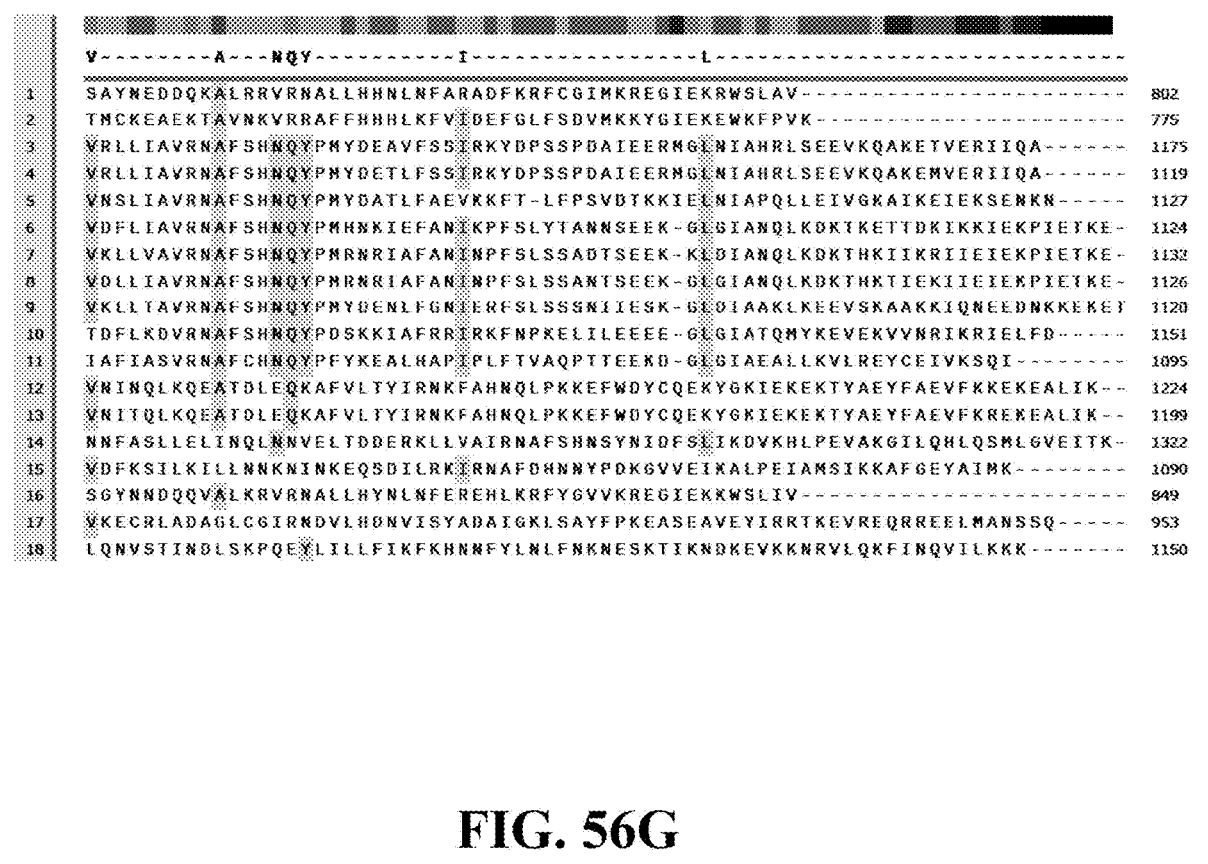

```
    V--------A---NQY----------I----------------L-----------------------------
1   SAYNEDDQKALRRVRNALLHHNLNFARADFKRFCGIMKREGIEKRWSLAV----------------------- 802
2   TNCKEAEKTAVNKVRRAFFHHHLKFVIDEFGLFSDVMKKYGIEKEWKFPVK---------------------- 775
3   VRLLIAVRNAFSHNQYPMYDEAVFSSIRKYDPSSPDAIEERNGLNIAHRLSEEVKQAKETVERIIQA------ 1175
4   VRLLIAVRNAFSHNQYPMYDETLFSSIRKYDPSSPDAIEERNGLNIAHRLSEEVKQAKEMVERIIQA------ 1119
5   VNSLIAVRNAFSHNQYPMYDATLFAEVKKFT-LFPSVDTKKIELNIAPQLLEIVGKAIKEIEKSENKN----- 1127
6   VDFLIAVRNAFSHNQYPMHNKIEFANIKPFSLYTANNSEEK-GLGIANQLKDKTKETTDKIKKIEKPIETKE- 1124
7   VKLLVAVRNAFSHNQYPMRNRIAFANINPFSLSSADTSEEK-KLDIANQLKDKTHKIIKRIIEIEKPIETKE- 1132
8   VDLLIAVRNAFSHNQYPMRNRIAFANINPFSLSSANTSEEK-GLGIANQLKDKTHKTIEKIIEIEKPIETKE- 1126
9   VKLLTAVRNAFSHNQYPMYDENLFGNIERFSLSSSNIIESK-GLDIAAKLKEEVSKAAKKIQNEEDNKKEKET 1120
10  TDFLKDVRNAFSHNQYPDSKKIAFRRIRKFNPKELILEEEE-GLGIATQMYKEVEKVVNRIKRIELFD----- 1151
11  IAFIASVRNAFCHNQYPFYKEALHAPIPLFTVAQPTTEEKD-GLGIAEALLKVLREYCEIVKSQI-------- 1095
12  VNINQLKQEATDLEQKAFVLTYIRNKFAHNQLPKKEFWDYCQEKYGKIEKEKTYAEYFAEVFKKEKEALIK-- 1224
13  VNITQLKQEATDLEQKAFVLTYIRNKFAHNQLPKKEFWDYCQEKYGKIEKEKTYAEYFAEVFKREKEALIK-- 1199
14  NNFASLLELINQLNNVELTDDERKLLVAIRNAFSHNSYNIDFSLIKDVKHLPEVAKGILQHLQSMLGVEITK- 1322
15  VDFKSILKILLNNKNINKEQSDILRKIRNAFDHNNYPDKGVVEIKALPEIAMSIKKAFGEYAIMK-------- 1090
16  SGYNNDQQVALKRVRNALLHYNLNFEREHLKRFYGVVKREGIEKKWSLIV----------------------- 849
17  VKECRLADAGLCGIRNDVLHDNVISYADAIGKLSAYFPKEASEAVEYIRRTKEVREQRREELMANSSQ----- 953
18  LQNVSTINDLSKPQEYLILLFIKFKHNNFYLNLFNKNESKTIKNDKEVKKNRVLQKFINQVILKKK------- 1150
```

FIG. 56G

| RESCUE Round | ADAR mutations | Plasmid |
|---|---|---|
| RESCUEv0 | E488Q | pAB0048 |
| RESCUEv1 | E488Q, V351G | pAB0359 |
| RESCUEv2 | E488Q, V351G, S486A | pAB1188 |
| RESCUEv3 | E488Q, V351G, S486A, T375S | pAB0642 |
| RESCUEv4 | E488Q, V351G, S486A, T375S, S370C, | pAB1072 |
| RESCUEv5 | E488Q, V351G, S486A, T375S, S370C, P462A | pAB1135 |
| RESCUEv6 | E488Q, V351G, S486A, T375S, S370C, P462A, N597I | pAB1146 |
| RESCUEv7 | E488Q, V351G, S486A, T375S, S370C, P462A, N597I, L332I | pAB1194 |
| RESCUEv8 | E488Q, V351G, S486A, T375S, S370C, P462A, N597I, L332I, I398V | pAB1220 |
| RESCUEv9 | E488Q, V351G, S486A, T375S, S370C, P462A, N597I, L332I, I398V, K350I | pAB1327 |
| RESCUEv10 | E488Q, V351G, S486A, T375S, S370C, P462A, N597I, L332I, I398V, K350I, M383L | pAB1411 |
| RESCUEv11 | E488Q, V351G, S486A, T375S, S370C, P462A, N597I, L332I, I398V, K350I, M383L, D619G | pAB1491 |
| RESCUEv12 | E488Q, V351G, S486A, T375S, S370C, P462A, N597I, L332I, I398V, K350I, M383L, D619G, S582T | pAB1553 |

FIG. 57

STAT3 mRNA
Y705C (A to I)

| P | E | A | D | P | G | S | A | A | P | Y | L | K | T | K | F | I |
|---|---|---|---|---|---|---|---|---|---|---|---|---|---|---|---|---|
| 695 | 696 | 697 | 698 | 699 | 700 | 701 | 702 | 703 | 704 | 705 | 706 | 707 | 708 | 709 | 710 | 711 |

5'—..AGCATCCTGAAGCTGACCCAGGTAGCGCTGCCCCATACCTGAAGACCAAGTTTATCT..

|||||||||||||||||||||||||||||||||||  |||||||||||||||||

TAGGACTTCGACTGGGTCCATCGCGACGGGGTA CGGACTTCTGGTTCAAAG — 5' guide RNA

STAT3 mRNA
S727F (C to U)

| T | C | S | N | T | I | D | L | P | M | S | P | R | T | L | D | S |
|---|---|---|---|---|---|---|---|---|---|---|---|---|---|---|---|---|
| 717 | 718 | 719 | 720 | 721 | 722 | 723 | 724 | 725 | 726 | 727 | 728 | 729 | 730 | 731 | 732 | 733 |

5'—..CAACGACCTGCAGCAATACCATTGACCTGCCGATGTCCCCCGCACTTTAGATTCAT..—3'

||||||||||||||||||||||||||||  |||||||||

TATGGTAACTGGACGGCTACACGGGGGCGTG guide RNA

*CTNNB1* mRNA
T41I (C to U)

D  S  G  I  H  S  G  A  T  T  A  P  S  L  S  G
32 33 34 35 36 37 38 39 40 41 42 43 44 45 46 47 48

5'—TACCTGGACTCTGGAATCCATTCTGGTGCCACTA CACAGCTCCTTCTCTGAGTGGT—3'
        | | | | | | | | | | | | | | | | | | | | |    | | | | | | | | | |
        TAGGTAAGACCACGGTGATTGTGTCGAGGAG
—3'                                      guide RNA C to U editing CTNNB1
mRNA RESCUE
targeting increased
CTNNB1 increased
growth

***Gaussia* luciferase mRNA**

C82R (C to U)

T   R   G   C   L   I   C   L   S   H   I   N   R   T   P   K   M   K   K   F   I   P
70  71  72  73  74  75  76  77  78  79  80  81  82  83  84  85  86  87  88  89  90  91

5'-..ACCAGGGGCUGUCUGAUCUGCCUGUCCCACAUCAAUGCACGCCCAAGAUGAAGAAGUUCAUCCCA..-3'

A

B

C

C

RESCUE candidate round

A

STAT3 mRNA
Y705C (A to I)

P   E   A   D   P   G   S   A   A   P   Y   L   K   T   K   F   I
695  696  697  698  699  700  701  702  703  704  705  706  707  708  709  710  711
5'—..AGCATCCTGAAGCTGACCCAGGTAGCGCTGCCCCAT⬛CCTGAAGACCAAGTTTATCT..—3'

STAT3 mRNA
S727F (C to U)

T   C   S   N   T   I   D   L   P   M   S   P   R   T   L   D   S
712  713  718  720  721  722  723  724  725  726  727  728  729  730  731  732  733
5'—..CAACGACCTGCAGCAATACCATTGACCTGCCGATGT⬛CCCCCGCACTTTAGATTCAT..—3'

CRISPR ENZYMES AND SYSTEMS

CROSS-REFERENCE TO RELATED APPLICATIONS

This application is a continuation application of U.S. application Ser. No. 17/264,340, filed Jan. 29, 2021, which is a 371 national phase entry of PCT/US2019/044480 filed Jul. 31, 2019, which claims the benefit of U.S. Provisional Application No. 62/712,809, filed Jul. 31, 2018, U.S. Provisional Application No. 62/751,421, filed Oct. 26, 2018, U.S. Provisional Application No. 62/775,865, filed Dec. 5, 2018, U.S. Provisional Application No. 62/822,639, filed Mar. 22, 2019, and U.S. Provisional Application No. 62/873,031, filed Jul. 11, 2019. The entire contents of the above-identified applications are hereby fully incorporated herein by reference.

STATEMENT REGARDING FEDERALLY SPONSORED RESEARCH

This invention was made with government support under Grant Nos. HG009761, MH110049 and HL141201 awarded by the National Institutes of Health. The government has certain rights in the invention.

REFERENCE TO AN ELECTRONIC SEQUENCE LISTING

The contents of the electronic sequence listing ("BROD-2660US-CON_ST26.xml"; Size is 1,763,394 bytes and it was created on Nov. 21, 2024) is herein incorporated by reference in its entirety.

TECHNICAL FIELD

The present invention generally relates to systems, methods and compositions used for the control of gene expression involving sequence targeting, such as perturbation of gene transcripts or nucleic acid editing, that may use vector systems related to Clustered Regularly Interspaced Short Palindromic Repeats (CRISPR) and components thereof.

BACKGROUND

The CRISPR-CRISPR associated (Cas) systems of bacterial and archaeal adaptive immunity are some such systems that show extreme diversity of protein composition and genomic loci architecture. The CRISPR-Cas system loci have more than 50 gene families and there is no strictly universal genes indicating fast evolution and extreme diversity of loci architecture. So far, adopting a multi-pronged approach, there is comprehensive cas gene identification of about 395 profiles for 93 Cas proteins. Classification includes signature gene profiles plus signatures of locus architecture. A new classification of CRISPR-Cas systems is proposed in which these systems are broadly divided into two classes, Class 1 with multisubunit effector complexes and Class 2 with single-subunit effector modules exemplified by the Cas9 protein. Novel effector proteins associated with Class 2 CRISPR-Cas systems may be developed as powerful genome engineering tools and the prediction of putative novel effector proteins and their engineering and optimization is important. Novel Cas13b orthologues and uses thereof are desirable.

Following the demonstration that CRISPR-Cas9 could be repurposed for genome editing, interest in leveraging CRISPR systems lead to the discovery of several new Cas enzymes and CRISPR systems with novel properties (1-3). Notable amongst these new discoveries are the Class 2 type VI CRISPR-Cas13 systems, which use a single enzyme to target RNA using a programmable CRISPR-RNA (crRNA) guide (1-6). Cas13 binding to target single-stranded RNA activates a general RNase activity that cleaves the target and degrades surrounding RNA non-specifically (4). Type VI systems have been used for RNA knockdown, transcript labeling, RNA editing, and ultra-sensitive virus detection (3, 4, 7-12). CRISPR-Cas13 systems are further divided into four subtypes based on the identity of the Cas13 protein (Cas13a-d) (2). All Cas13 protein family members contain two Higher Eukaryotes and Prokaryotes Nucleotide-binding (HEPN) domains. Citation or identification of any document in this application is not an admission that such document is available as prior art to the present invention.

There exists a pressing need for alternative and robust systems and techniques for targeting nucleic acids or polynucleotides (e.g. DNA or RNA or any hybrid or derivative thereof) with a wide array of applications, in particular development of effector proteins having an altered functionality, such as including, but not limited to increased or decreased specificity, increased or decreased activity, altered specificity and/or activity, alternative PAM recognition, etc. This invention addresses this need and provides related advantages. Adding the novel RNA-targeting systems of the present application to the repertoire of genomic, transcriptomic, and epigenomic targeting technologies may transform the study and perturbation or editing of specific target sites through direct detection, analysis and manipulation. To utilize the RNA-targeting systems of the present application effectively for RNA targeting without deleterious effects, it is critical to understand aspects of engineering and optimization of these RNA targeting tools.

SUMMARY

In one aspect, the present disclosure provides an engineered CRISPR-Cas protein comprising one or more HEPN domains and further comprising one or more modified amino acids, wherein the amino acids: interact with a guide RNA that forms a complex with the engineered CRISPR-Cas protein; are in a HEPN active site, an inter-domain linker domain, a lid domain, a helical domain 1, a helical domain 2, or a bridge helix domain of the engineered CRISPR-Cas protein; or a combination thereof.

In some embodiments, the HEPN domain comprises RxxxxH motif. In some embodiments, the RxxxxH motif comprises a R{N/H/K}$X_1X_2X_3$H (SEQ ID NO:78) sequence. In some embodiments, in the R{N/H/K}$X_1X_2X_3$H sequence, $X_1$ is R, S, D, E, Q, N, G, or Y, $X_2$ is independently I, S, T, V, or L, and $X_3$ is independently L, F, N, Y, V, I, S, D, E, or A.

In some embodiments, the CRISPR-Cas protein is a Type VI CRISPR Cas protein. In some embodiments, the Type VI CRISPR Cas protein is Cas13. In some embodiments, the Type VI CRISPR Cas protein is a Cas13a, a Cas13b, a Cas13c, or a Cas13d.

In some embodiments, one or more mutation of an amino acid corresponding to the following amino acids of *Prevotella buccae* Cas13b (PbCas13b): T405, H407, K457, H500, K570, K590, N634, R638, N652, N653, K655, S658, K741, K744, N756, S757, R762, R791, K846, K857, K870, R877, K183, K193, R600, K607, K612, R614, K617, K826, K828, K829, R824, R830, Q831, K835, K836, R838, R618, D434, K431, R53, K943, R1041, Y164, R285, R287, K292, E296, N297, Q646, N647, R402, K393, N653, N652, R482, N480, D396, E397, D398, E399, K294, E400, R56, N157, H161, H452, N455, K484, N486, G566, H567, A656, V795, A796, W842, K871, E873, R874, R1068, N1069, or H1073.

In some embodiments, one or more mutation of an amino acid corresponding to the following amino acids of *Prevotella buccae* Cas13b (PbCas13b): H407, K457, H500, K570, K590, N634, R638, N652, N653, K655, S658, K741, K744, N756, S757, R762, R791, K846, K857, K870, R877, K183, K193, R600, K607, K612, R614, K617, K826, K828, K829, R824, R830, Q831, K835, K836, R838, R618, D434, K431, R53, K943, R1041, Y164, R285, R287, K292, E296, N297, Q646, N647, R402, K393, N653, N652, R482, N480, D396, E397, D398, E399, K294, E400, R56, N157, H161, H452, N455, K484, N486, G566, H567, W842, K871, E873, R874, R1068, N1069, H1073.

In some embodiments, one or more mutation of an amino acid corresponding to the following amino acids of *Prevotella buccae* Cas13b (PbCas13b): T405, H407, K457, H500, K570, K590, N634, R638, N652, N653, K655, S658, K741, K744, N756, S757, R762, R791, K846, K857, K870, R877, K183, K193, R600, K607, K612, R614, K617, K826, K828, K829, R824, R830, Q831, K835, K836, R838, R618, D434, K431, R53, K943, R1041, Y164, R285, R287, K292, E296, N297, Q646, N647, R402, K393, N653, N652, R482, N480, D396, E397, D398, E399, K294, or E400.

In some embodiments, one or more mutation of an amino acid corresponding to the following amino acids of *Prevotella buccae* Cas13b (PbCas13b): K393, R402, N482, T405, H407, S658, N653, A656, K655, N652, H567, N455, H500, K871, K857, K870, W842, E873, R877, K846, R874, R762, V795, A796, R791, G566, K590, R638, H452, S757, N756, N486, K484, N480, K457, K741, R56, N157, H161, R1068, N1069, or H1073.

In some embodiments, one or more mutation of an amino acid corresponding to the following amino acids of PbCas13b: K393, R402, N482, H407, S658, N653, K655, N652, H567, N455, H500, K871, K857, K870, W842, E873, R877, K846, R874, R762, R791, G566, K590, R638, H452, S757, N756, N486, K484, N480, K457, K741, R56, N157, H161, R1068, N1069, or H1073.

In some embodiments, one or more mutation of an amino acid corresponding to the following amino acids of PbCas13b: W842, K846, K870, E873, or R877. In some embodiments, in helical domain 1 one or more mutation of an amino acid corresponding to the following amino acids in helical domain 1 of PbCas13b: W842, K846, K870, E873, or R877. In some embodiments, in helical domain 1-3 one or more mutation of an amino acid corresponding to the following amino acids in helical domain 1-3 of PbCas13b: W842, K846, K870, E873, or R877. In some embodiments, in the bridge helix domain one or more mutation of an amino acid corresponding to the following amino acids in the bridge helix domain of PbCas13b: W842, K846, K870, E873, or R877. In some embodiments, one or more mutation of an amino acid corresponding to the following amino acids of PbCas13b: K393, R402, N480, N482, N652, or N653. In some embodiments, one or more mutation of an amino acid corresponding to the following amino acids of PbCas13b: K393, R402, N480, or N482. In some embodiments, in the LID domain one or more mutation of an amino acid corresponding to the following amino acids in the LID domain of PbCas13b: K393, R402, N480, or N482. In some embodiments, one or more mutation of an amino acid corresponding to the following amino acids of PbCas13b: N652 or N653. In some embodiments, in helical domain 2 one or more mutation of an amino acid corresponding to the following amino acids in helical domain 2 of PbCas13b: N652 or N653. In some embodiments, one or more mutation of an amino acid corresponding to the following amino acids of PbCas13b: T405, H407, S658, N653, A656, K655, N652, H567, N455, H500, K871, K857, K870, W842, E873, R877, K846, R874, R762, V795, A796, R791, G566, K590, R638, H452, S757, N756, N486, K484, N480, K457, or K741. In some embodiments, one or more mutation of an amino acid corresponding to the following amino acids of PbCas13b: H407, S658, N653, K655, N652, H567, N455, H500, K871, K857, K870, W842, E873, R877, K846, R874, R762, R791, G566, K590, R638, H452, S757, N756, N486, K484, N480, K457, or K741. In some embodiments, one or more mutation of an amino acid corresponding to the following amino acids of PbCas13b: S658, N653, A656, K655, N652, H567, H500, K871, K857, K870, W842, E873, R877, K846, R874, R762, V795, A796, R791, G566, K590, R638, S757, N756, or K741. In some embodiments, in a helical domain one or more mutation of an amino acid corresponding to the following amino acids in a helical domain of PbCas13b: S658, N653, A656, K655, N652, H567, H500, K871, K857, K870, W842, E873, R877, K846, R874, R762, V795, A796, R791, G566, K590, R638, S757, N756, or K741. In some embodiments, one or more mutation of an amino acid corresponding to the following amino acids of PbCas13b: H567, H500, K871, K857, K870, W842, E873, R877, K846, R874, R762, V795, A796, R791, G566, S757, or N756.

In some embodiments, in helical domain 1 one or more mutation of an amino acid corresponding to the following amino acids in helical domain 1 of PbCas13b: H567, H500, K871, K857, K870, W842, E873, R877, K846, R874, R762, V795, A796, R791, G566, S757, or N756. In some embodiments, one or more mutation of an amino acid corresponding to the following amino acids of PbCas13b: H567, H500, R762, V795, A796, R791, G566, S757, or N756. In some embodiments, in helical domain 1 one or more mutation of an amino acid corresponding to the following amino acids in helical domain 1 of PbCas13b: H567, H500, R762, V795, A796, R791, G566, S757, or N756. In some embodiments, one or more mutation of an amino acid corresponding to the following amino acids of PbCas13b: K871, K857, K870, W842, E873, R877, K846, or R874. In some embodiments, in the bridge helix domain one or more mutation of an amino acid corresponding to the following amino acids in the bridge helix domain of PbCas13b: K871, K857, K870, W842, E873, R877, K846, or R874. In some embodiments, one or more mutation of an amino acid corresponding to the following amino acids of PbCas13b: H567, H500, or G566.

In some embodiments, in helical domain 1-2 one or more mutation of an amino acid corresponding to the following amino acids in helical domain 1-2 of PbCas13b: H567, H500, or G566. In some embodiments, one or more mutation of an amino acid corresponding to the following amino acids of PbCas13b: K871, K857, K870, W842, E873, R877, K846, R874, R762, V795, A796, R791, S757, or N756. In some embodiments, in helical domain 1-3 one or more mutation of an amino acid corresponding to the following amino acids in helical domain 1-3 of PbCas13b: K871, K857, K870, W842, E873, R877, K846, R874, R762, V795, A796, R791, S757, or N756. In some embodiments, one or more mutation of an amino acid corresponding to the following amino acids of PbCas13b: R762, V795, A796, R791, S757, or N756. In some embodiments, in helical domain 1-3 one or more mutation of an amino acid corresponding to the following amino acids in helical domain 1-3 of PbCas13b: R762, V795, A796, R791, S757, or N756. In some embodiments, one or more mutation of an amino acid corresponding to the following amino acids of PbCas13b: S658, N653, A656, K655, N652, K590, R638, or K741. In some embodiments, in helical domain 2 one or more mutation of an amino acid corresponding to the following amino acids in helical domain 2 of PbCas13b: S658, N653, A656, K655, N652, K590, R638, or K741. In some embodiments, one or more mutation of an amino acid corresponding to the following amino acids of PbCas13b: T405, H407, N486, K484, N480, H452, N455, or K457. In some embodiments, in the LID domain one or more mutation of an amino acid corresponding to the following amino acids in the LID domain of PbCas13b: T405, H407, N486, K484, N480, H452, N455, or K457. In some embodiments, one or more mutation of an amino acid corresponding to the following amino acids of PbCas13b: S658, N653, K655, N652, H567, H500, K871, K857, K870, W842, E873, R877, K846, R874, R762, R791, G566, K590, R638, S757, N756, or K741. In some embodiments, in a helical domain one or more mutation of an amino acid corresponding to the following amino acids in a helical domain of PbCas13b: S658, N653, K655, N652, H567, H500, K871, K857, K870, W842, E873, R877, K846, R874, R762, R791, G566, K590, R638, S757, N756, or K741. In some embodiments, one or more mutation of an amino acid corresponding to the following amino acids of PbCas13b: H567, H500, K871, K857, K870, W842, E873, R877, K846, R874, R762, R791, G566, S757, or N756. In some embodiments, in helical domain 1 one or more mutation of an amino acid corresponding to the following amino acids in helical domain 1 of PbCas13b: H567, H500, K871, K857, K870, W842, E873, R877, K846, R874, R762, R791, G566, S757, or N756. In some embodiments, one or more mutation of an amino acid corresponding to the following amino acids of PbCas13b: H567, H500, R762, R791, G566, S757, or N756. In some embodiments, in helical domain 1 one or more mutation of an amino acid corresponding to the following amino acids in helical domain 1 of PbCas13b: H567, H500, R762, R791, G566, S757, or N756. In some embodiments, one or more mutation of an amino acid corresponding to the following amino acids of PbCas13b: K871, K857, K870, W842, E873, R877, K846, R874, R762, R791, S757, or N756. In some embodiments, in helical domain 1-3 one or more mutation of an amino acid corresponding to the following amino acids in helical domain 1-3 of PbCas13b: K871, K857, K870, W842, E873, R877, K846, R874, R762, R791, S757, or N756. In some embodiments, one or more mutation of an amino acid corresponding to the following amino acids of PbCas13b: R762, R791, S757, or N756. In some embodiments, in helical domain 1-3 one or more mutation of an amino acid corresponding to the following amino acids in helical domain 1-3 of PbCas13b: R762, R791, S757, or N756. In some embodiments, one or more mutation of an amino acid corresponding to the following amino acids of PbCas13b: S658, N653, K655, N652, K590, R638, or K741. In some embodiments, in helical domain 2 one or more mutation of an amino acid corresponding to the following amino acids in helical domain 2 of PbCas13b: S658, N653, K655, N652, K590, R638, or K741. In some embodiments, one or more mutation of an amino acid corresponding to the following amino acids of PbCas13b: H407, N486, K484, N480, H452, N455, or K457.

In some embodiments, in the LID domain one or more mutation of an amino acid corresponding to the following amino acids in the LID domain of PbCas13b: H407, N486, K484, N480, H452, N455, or K457. In some embodiments, one or more mutation of an amino acid corresponding to the following amino acids of PbCas13b: R56, N157, H161, R1068, N1069, or H1073. In some embodiments, in a HEPN domain one or more mutation of an amino acid corresponding to the following amino acids in a HEPN domain of PbCas13b: R56, N157, H161, R1068, N1069, or H1073. In some embodiments, one or more mutation of an amino acid corresponding to the following amino acids of PbCas13b: R56, N157, or H161. In some embodiments, in HEPN domain 1 one or more mutation of an amino acid corresponding to the following amino acids in HEPN domain 1 of PbCas13b: R56, N157, or H161. In some embodiments, one or more mutation of an amino acid corresponding to the following amino acids of PbCas13b: R1068, N1069, or H1073. In some embodiments, in HEPN domain 2 one or more mutation of an amino acid corresponding to the following amino acids in HEPN domain 2 of PbCas13b: R1068, N1069, or H1073. In some embodiments, one or more mutation of an amino acid corresponding to the following amino acids of PbCas13b: K393, R402, N482, T405, H407, N486, K484, N480, H452, N455, or K457. In some embodiments, in the LID domain one or more mutation of an amino acid corresponding to the following amino acids in the LID domain of PbCas13b: K393, R402, N482, T405, H407, N486, K484, N480, H452, N455, or K457. In some embodiments, one or more mutation of an amino acid corresponding to the following amino acids of PbCas13b: K393, R402, N482, H407, N486, K484, N480, H452, N455, or K457. In some embodiments, in the LID domain one or more mutation of an amino acid corresponding to the following amino acids in the LID domain of PbCas13b: K393, R402, N482, H407, N486, K484, N480, H452, N455, or K457. In some embodiments, one or more mutation of an amino acid corresponding to the following amino acids of PbCas13b: T405, H407, S658, N653, A656, K655, N652, H567, N455, H500, K871, K857, K870, W842, E873, R877, K846, R874, R762, V795, A796, R791, G566, K590, R638, H452, S757, N756, N486, K484, N480, K457, K741, K393, R402, or N482. In some embodiments, one or more mutation of an amino acid corresponding to the following amino acids of PbCas13b: H407, S658, N653, K655, N652, H567, N455, H500, K871, K857, K870, W842, E873, R877, K846, R874, R762, R791, G566, K590, R638, H452, S757, N756, N486, K484, N480, K457, K741, K393, R402, or N482. In some embodiments, one or more mutation of an amino acid corresponding to the following amino acids of PbCas13b: S658, N653, A656, K655, N652, H567, N455, H500, K871, K857, K870, W842, E873, R877, K846, R874, R762, V795, A796, R791, G566, K590, R638, H452, S757, N756, N486, K484, N480, K457, or K741. In some embodiments, one or more mutation of an amino acid corresponding to the following amino acids of PbCas13b: S658, N653, K655, N652, H567, N455, H500, K871, K857, K870, W842, E873, R877, K846, R874, R762, R791, G566, K590, R638, H452, S757, N756, N486, K484, N480, K457, or K741. In some embodiments, one or more mutation of an amino acid corresponding to the following amino acids of PbCas13b: N486, K484, N480, H452, N455, or K457.

In some embodiments, in the LID domain one or more mutation of an amino acid corresponding to the following amino acids in the LID domain of PbCas13b: N486, K484, N480, H452, N455, or K457. In some embodiments, one or more mutation of an amino acid corresponding to the following amino acids of PbCas13b: K393, R402, N482, N486, K484, N480, H452, N455, or K457. In some embodiments, in the LID domain one or more mutation of an amino acid corresponding to the following amino acids in the LID domain of PbCas13b: K393, R402, N482, N486, K484, N480, H452, N455, or K457. In some embodiments, one or more mutation of an amino acid corresponding to the following amino acids of PbCas13b: S658, N653, A656, K655, N652, H567, N455, H500, K871, K857, K870, W842, E873, R877, K846, R874, R762, V795, A796, R791, G566, K590, R638, H452, S757, N756, N486, K484, N480, K457, K741, K393, R402, or N482. In some embodiments, one or more mutation of an amino acid corresponding to the following amino acids of PbCas13b: S658, N653, K655, N652, H567, N455, H500, K871, K857, K870, W842, E873, R877, K846, R874, R762, R791, G566, K590, R638, H452, S757, N756, N486, K484, N480, K457, K741, K393, R402, or N482.

In some embodiments, one or more mutation of an amino acid corresponding to the following amino acids of *Prevotella buccae* Cas13b (PbCas13b): R53, Y164, K943, or R1041. In some embodiments, one or more mutation of an amino acid corresponding to the following amino acids of *Prevotella buccae* Cas13b (PbCas13b): R53 or Y164. In some embodiments, one or more mutation of an amino acid corresponding to the following amino acids of *Prevotella buccae* Cas13b (PbCas13b): K943 or R1041. In some embodiments, in a HEPN domain one or more mutation of an amino acid corresponding to the following amino acids in a HEPN domain of *Prevotella buccae* Cas13b (PbCas13b): R53, Y164, K943, or R1041. In some embodiments, in HEPN domain 1 one or more mutation of an amino acid corresponding to the following amino acids in HEPN domain 1 of *Prevotella buccae* Cas13b (PbCas13b): R53 or Y164. In some embodiments, in HEPN domain 2 one or more mutation of an amino acid corresponding to the following amino acids in HEPN domain 2 of *Prevotella buccae* Cas13b (PbCas13b): K943 or R1041. In some embodiments, one or more mutation of an amino acid corresponding to the following amino acids of *Prevotella buccae* Cas13b (PbCas13b): R53, Y164, K943, R1041, R56, N157, H161, R1068, N1069, or H1073. In some embodiments, one or more mutation of an amino acid corresponding to the following amino acids of *Prevotella buccae* Cas13b (PbCas13b): R53, Y164, R56, N157, or H161. In some embodiments, one or more mutation of an amino acid corresponding to the following amino acids of *Prevotella buccae* Cas13b (PbCas13b): K943, R1041, R1068, N1069, or H1073. In some embodiments, in a HEPN domain one or more mutation of an amino acid corresponding to the following amino acids in a HEPN domain of *Prevotella buccae* Cas13b (PbCas13b): R53, Y164, K943, R1041, R56, N157, H161, R1068, N1069, or H1073. In some embodiments, in HEPN domain 1 one or more mutation of an amino acid corresponding to the following amino acids in HEPN domain 1 of *Prevotella buccae* Cas13b (PbCas13b): R53, Y164, R56, N157, or H161. In some embodiments, in HEPN domain 2 one or more mutation of an amino acid corresponding to the following amino acids in HEPN domain 2 of *Prevotella buccae* Cas13b (PbCas13b): K943, R1041, R1068, N1069, or H1073. In some embodiments, one or more mutation of an amino acid corresponding to the following amino acids of *Prevotella buccae* Cas13b (PbCas13b): R53, Y164, K183, K193, K943, or R1041. In some embodiments, one or more mutation of an amino acid corresponding to the following amino acids of *Prevotella buccae* Cas13b (PbCas13b): R53, Y164, K183, or K193. In some embodiments, one or more mutation of an amino acid corresponding to the following amino acids of *Prevotella buccae* Cas13b (PbCas13b): K943 or R1041.

In some embodiments, in a HEPN domain one or more mutation of an amino acid corresponding to the following amino acids in a HEPN domain of *Prevotella buccae* Cas13b (PbCas13b): R53, Y164, K183, K193, K943, or R1041. In some embodiments, in HEPN domain 1 one or more mutation of an amino acid corresponding to the following amino acids in HEPN domain 1 of *Prevotella buccae* Cas13b (PbCas13b): R53, Y164, K183, or K193. In some embodiments, in HEPN domain 2 one or more mutation of an amino acid corresponding to the following amino acids in HEPN domain 2 of *Prevotella buccae* Cas13b (PbCas13b): K943 or R1041. In some embodiments, one or more mutation of an amino acid corresponding to the following amino acids of *Prevotella buccae* Cas13b (PbCas13b): R53, Y164, K183, K193, K943, R1041, R56, N157, H161, R1068, N1069, or H1073. In some embodiments, one or more mutation of an amino acid corresponding to the following amino acids of *Prevotella buccae* Cas13b (PbCas13b): R53, Y164, K183, K193, R56, N157, or H161. In some embodiments, one or more mutation of an amino acid corresponding to the following amino acids of *Prevotella buccae* Cas13b (PbCas13b): K943, R1041, R1068, N1069, or H1073. In some embodiments, in a HEPN domain one or more mutation of an amino acid corresponding to the following amino acids in a HEPN domain of *Prevotella buccae* Cas13b (PbCas13b): R53, Y164, K183, K193, K943, R1041, R56, N157, H161, R1068, N1069, or H1073. In some embodiments, in HEPN domain 1 one or more mutation of an amino acid corresponding to the following amino acids in HEPN domain 1 of *Prevotella buccae* Cas13b (PbCas13b): R53, Y164, K183, K193, R56, N157, or H161.

In some embodiments, in HEPN domain 2 one or more mutation of an amino acid corresponding to the following amino acids in HEPN domain 2 of *Prevotella buccae* Cas13b (PbCas13b): K943, R1041, R1068, N1069, or H1073. In some embodiments, one or more mutation of an amino acid corresponding to the following amino acids of *Prevotella buccae* Cas13b (PbCas13b): K183 or K193. In some embodiments, in HEPN domain 1 one or more mutation of an amino acid corresponding to the following amino acids in HEPN domain 1 of *Prevotella buccae* Cas13b (PbCas13b): K183 or K193. In some embodiments, one or more mutation of an amino acid corresponding to the following amino acids of *Prevotella buccae* Cas13b (PbCas13b): R53, Y164, K943, or R1041. In some embodiments, in a HEPN domain one or more mutation of an amino acid corresponding to the following amino acids in a HEPN domain of *Prevotella buccae* Cas13b (PbCas13b): R53, Y164, K943, or R1041. In some embodiments, one or more mutation of an amino acid corresponding to the following amino acids of *Prevotella buccae* Cas13b (PbCas13b): R53, K943, or R1041; preferably R53A, R53K, R53D, or R53E; K943A, K943R, K943D, or K943E; or R1041A, R1041K, R1041D, or R1041E. In some embodiments, in a HEPN domain one or more mutation of an amino acid corresponding to the following amino acids in a HEPN domain of *Prevotella buccae* Cas13b (PbCas13b): R53, K943, or R1041; preferably R53A, R53K, R53D, or R53E; K943A, K943R, K943D, or K943E; or R1041A, R1041K, R1041D, or R1041E. In some embodiments, a mutation of an amino acid corresponding to amino acid Y164 of *Prevotella buccae* Cas13b (PbCas13b), preferably Y164A, Y164F, or Y164W.

In some embodiments, HEPN domain 1 a mutation of an amino acid corresponding to amino acid Y164 HEPN domain 1 of *Prevotella buccae* Cas13b (PbCas13b), preferably Y164A, Y164F, or Y164W. In some embodiments, one or more mutation of an amino acid corresponding to the following amino acids of *Prevotella buccae* Cas13b (PbCas13b): T405, H407, K457, D434, K431, R402, K393, R482, N480, D396, E397, D398, or E399. In some embodiments, in the LID domain one or more mutation of an amino acid corresponding to the following amino acids in the LID domain of *Prevotella buccae* Cas13b (PbCas13b): T405, H407, K457, D434, K431, R402, K393, R482, N480, D396, E397, D398, or E399. In some embodiments, a mutation of an amino acid corresponding to amino acid H407 of *Prevotella buccae* Cas13b (PbCas13b), preferably H407Y, H407W, or H407F. In some embodiments, one or more mutation of an amino acid corresponding to the following amino acids of *Prevotella buccae* Cas13b (PbCas13b): R402, K393, R482, N480, D396, E397, D398, or E399. In some embodiments, in the LID domain one or more mutation of an amino acid corresponding to the following amino acids in the LID domain of *Prevotella buccae* Cas13b (PbCas13b): R402, K393, R482, N480, D396, E397, D398, or E399. In some embodiments, one or more mutation of an amino acid corresponding to the following amino acids of *Prevotella buccae* Cas13b (PbCas13b): K457, D434, or K431. In some embodiments, in the LID domain one or more mutation of an amino acid corresponding to the following amino acids in the LID domain of *Prevotella buccae* Cas13b (PbCas13b): K457, D434, or K431.

In some embodiments, one or more mutation of an amino acid corresponding to the following amino acids of *Prevotella buccae* Cas13b (PbCas13b): H500, K570, K590, N634, R638, N652, N653, K655, S658, K741, K744, N756, S757, R762, R791, K846, K857, K870, R877, R600, K607, K612, R614, K617, K826, K828, K829, R824, R830, Q831, K835, K836, R838, R618, Q646, N647, N653, or N652. In some embodiments, in a helical domain one or more mutation of an amino acid corresponding to the following amino acids in a helical domain of *Prevotella buccae* Cas13b (PbCas13b): H500, K570, K590, N634, R638, N652, N653, K655, S658, K741, K744, N756, S757, R762, R791, K846, K857, K870, R877, R600, K607, K612, R614, K617, K826, K828, K829, R824, R830, Q831, K835, K836, R838, R618, Q646, N647, N653, or N652. In some embodiments, one or more mutation of an amino acid corresponding to the following amino acids of *Prevotella buccae* Cas13b (PbCas13b): H500, K570, N756, S757, R762, R791, K846, K857, K870, R877, K826, K828, K829, R824, R830, Q831, K835, K836, or R838. In some embodiments, in helical domain 1 one or more mutation of an amino acid corresponding to the following amino acids in helical domain 1 of *Prevotella buccae* Cas13b (PbCas13b): H500, K570, N756, S757, R762, R791, K846, K857, K870, R877, K826, K828, K829, R824, R830, Q831, K835, K836, or R838. In some embodiments, one or more mutation of an amino acid corresponding to the following amino acids of *Prevotella buccae* Cas13b (PbCas13b): H500, K570, N756, S757, R762, or R791. In some embodiments, in helical domain 1 one or more mutation of an amino acid corresponding to the following amino acids in helical domain 1 of *Prevotella buccae* Cas13b (PbCas13b): H500, K570, N756, S757, R762, or R791.

In some embodiments, one or more mutation of an amino acid corresponding to the following amino acids of *Prevotella buccae* Cas13b (PbCas13b): K846, K857, K870, R877, K826, K828, K829, R824, R830, Q831, K835, K836, or R838. In some embodiments, in the bridge helix domain one or more mutation of an amino acid corresponding to the following amino acids in the bridge helix domain of *Prevotella buccae* Cas13b (PbCas13b): K846, K857, K870, R877, K826, K828, K829, R824, R830, Q831, K835, K836, or R838. In some embodiments, one or more mutation of an amino acid corresponding to the following amino acids of *Prevotella buccae* Cas13b (PbCas13b): H500 or K570. In some embodiments, in helical domain 1-2 one or more mutation of an amino acid corresponding to the following amino acids in helical domain 1-2 of *Prevotella buccae* Cas13b (PbCas13b): H500 or K570. In some embodiments, one or more mutation of an amino acid corresponding to the following amino acids of *Prevotella buccae* Cas13b (PbCas13b): N756, S757, R762, R791, K846, K857, K870, R877, K826, K828, K829, R824, R830, Q831, K835, K836, or R838. In some embodiments, in helical domain 1-3 one or more mutation of an amino acid corresponding to the following amino acids in helical domain 1-3 of *Prevotella buccae* Cas13b (PbCas13b): N756, S757, R762, R791, K846, K857, K870, R877, K826, K828, K829, R824, R830, Q831, K835, K836, or R838. In some embodiments, one or more mutation of an amino acid corresponding to the following amino acids of *Prevotella buccae* Cas13b (PbCas13b): N756, S757, R762, or R791. In some embodiments, in helical domain 1-3 one or more mutation of an amino acid corresponding to the following amino acids in helical domain 1-3 of *Prevotella buccae* Cas13b (PbCas13b): N756, S757, R762, or R791. In some embodiments, one or more mutation of an amino acid corresponding to the following amino acids of *Prevotella buccae* Cas13b (PbCas13b): N756, S757, R762, R791, K846, K857, K870, or R877. In some embodiments, in helical domain 1-3 one or more mutation of an amino acid corresponding to the following amino acids in helical domain 1-3 of *Prevotella buccae* Cas13b (PbCas13b): N756, S757, R762, R791, K846, K857, K870, or R877. In some embodiments, one or more mutation of an amino acid corresponding to the following amino acids of *Prevotella buccae* Cas13b (PbCas13b): K826, K828, K829, R824, R830, Q831, K835, K836, or R838. In some embodiments, in helical domain 1-3 one or more mutation of an amino acid corresponding to the following amino acids in helical domain 1-3 of *Prevotella buccae* Cas13b (PbCas13b): K826, K828, K829, R824, R830, Q831, K835, K836, or R838. In some embodiments, one or more mutation of an amino acid corresponding to the following amino acids of *Prevotella buccae* Cas13b (PbCas13b): K590, N634, R638, N652, N653, K655, S658, K741, K744, R600, K607, K612, R614, K617, R618, Q646, N647, N653, or N652. In some embodiments, in helical domain 2 one or more mutation of an amino acid corresponding to the following amino acids in helical domain 2 of *Prevotella buccae* Cas13b (PbCas13b): K590, N634, R638, N652, N653, K655, S658, K741, K744, R600, K607, K612, R614, K617, R618, Q646, N647, N653, or N652.

In some embodiments, one or more mutation of an amino acid corresponding to the following amino acids of *Prevotella buccae* Cas13b (PbCas13b): Q646 or N647. In some embodiments, in helical domain 2 one or more mutation of an amino acid corresponding to the following amino acids in helical domain 2 of *Prevotella buccae* Cas13b (PbCas13b): Q646 or N647. In some embodiments, one or more mutation of an amino acid corresponding to the following amino acids of *Prevotella buccae* Cas13b (PbCas13b): N653 or N652. In some embodiments, in helical domain 2 one or more mutation of an amino acid corresponding to the following amino acids in helical domain 2 of *Prevotella buccae* Cas13b (PbCas13b): N653 or N652. In some embodiments, one or more mutation of an amino acid corresponding to the following amino acids of *Prevotella buccae* Cas13b (PbCas13b): K590, N634, R638, N652, N653, K655, S658, K741, or K744. In some embodiments, in helical domain 2 one or more mutation of an amino acid corresponding to the following amino acids in helical domain 2 of *Prevotella buccae* Cas13b (PbCas13b): K590, N634, R638, N652, N653, K655, S658, K741, or K744. In some embodiments, one or more mutation of an amino acid corresponding to the following amino acids of *Prevotella buccae* Cas13b (PbCas13b): R600, K607, K612, R614, K617, or R618. In some embodiments, in helical domain 2 one or more mutation of an amino acid corresponding to the following amino acids in helical domain 2 of *Prevotella buccae* Cas13b (PbCas13b): R600, K607, K612, R614, K617, or R618. In some embodiments, one or more mutation of an amino acid corresponding to the following amino acids of *Prevotella buccae* Cas13b (PbCas13b): R285, R287, K292, E296, N297, or K294. In some embodiments, in the IDL domain one or more mutation of an amino acid corresponding to the following amino acids in the IDL domain of *Prevotella buccae* Cas13b (PbCas13b): R285, R287, K292, E296, N297, or K294. In some embodiments, one or more mutation of an amino acid corresponding to the following amino acids of *Prevotella buccae* Cas13b (PbCas13b): R285, K292, E296, or N297. In some embodiments, in the IDL domain one or more mutation of an amino acid corresponding to the following amino acids in the IDL domain of *Prevotella buccae* Cas13b (PbCas13b): R285, K292, E296, or N297.

In some embodiments, one or more mutation of an amino acid corresponding to the following amino acids of *Prevotella buccae* Cas13b (PbCas13b): T405, H500, K570, K590, N634, R638, N652, N653, K655, S658, K741, K744, N756, S757, R762, R791, K846, K857, K870, R877, K183, K193, R600, K607, K612, R614, K617, K826, K828, K829, R824, R830, Q831, K835, K836, R838, R618, D434, K431, R285, R287, K292, E296, N297, Q646, N647, or K294. In some embodiments, one or more mutation of an amino acid corresponding to the following amino acids of *Prevotella buccae* Cas13b (PbCas13b): R402, K393, N653, N652, R482, N480, D396, E397, D398, or E399. In some embodiments, one or more mutation of an amino acid corresponding to the following amino acids of *Prevotella buccae* Cas13b (PbCas13b): R53, K655, R762, or R1041; preferably R53A or R53D; K655A; R762A; or R1041E or R1041D. In some embodiments, one or more mutation of an amino acid corresponding to the following amino acids of *Prevotella buccae* Cas13b (PbCas13b): N297, E296, K292, or R285; preferably N297A, E296A, K292A, or R285A. In some embodiments, in (the central channel of) the IDL domain one or more mutation of an amino acid corresponding to the following amino acids in (the central channel of) the IDL domain of *Prevotella buccae* Cas13b (PbCas13b): N297, E296, K292, or R285; preferably N297A, E296A, K292A, or R285A. In some embodiments, one or more mutation of an amino acid corresponding to the following amino acids of *Prevotella buccae* Cas13b (PbCas13b): Q831, K836, R838, N652, N653, R830, K655 or R762; preferably Q831A, K836A, R838A, N652A, N653A, R830A, K655A, or R762A. In some embodiments, one or more mutation of an amino acid corresponding to the following amino acids of *Prevotella buccae* Cas13b (PbCas13b): N652, N653, R830, K655 or R762; preferably N652A, N653A, R830A, K655A, or R762A. In some embodiments, one or more mutation of an amino acid corresponding to the following amino acids of *Prevotella buccae* Cas13b (PbCas13b): K655 or R762; preferably K655A or R762A. In some embodiments, in a helical domain one or more mutation of an amino acid corresponding to the following amino acids in a helical domain of *Prevotella buccae* Cas13b (PbCas13b): Q831, K836, R838, N652, N653, R830, K655 or R762; preferably Q831A, K836A, R838A, N652A, N653A, R830A, K655A, or R762A.

In some embodiments, a helical domain one or more mutation of an amino acid corresponding to the following amino acids a helical domain of *Prevotella buccae* Cas13b (PbCas13b): N652, N653, R830, K655 or R762; preferably N652A, N653A, R830A, K655A, or R762A. In some embodiments, in helical domain 2 one or more mutation of an amino acid corresponding to the following amino acids in helical domain 2 of *Prevotella buccae* Cas13b (PbCas13b): K655 or R762; preferably K655A or R762A. In some embodiments, one or more mutation of an amino acid corresponding to the following amino acids of *Prevotella buccae* Cas13b (PbCas13b): R614, K607, K193, K183 or R600; preferably R614A, K607A, K193A, K183A or R600A. In some embodiments, in the trans-subunit loop of helical domain 2 one or more mutation of an amino acid corresponding to the following amino acids in the trans-subunit loop of helical domain 2 of *Prevotella buccae* Cas13b (PbCas13b): Q646 or N647; preferably Q646A or N647A. In some embodiments, one or more mutation of an amino acid corresponding to the following amino acids of *Prevotella buccae* Cas13b (PbCas13b): R53 or R1041; preferably R53A or R53D, or R1041E or R1041D. In some embodiments, in a HEPN domain one or more mutation of an amino acid corresponding to the following amino acids in a HEPN domain of *Prevotella buccae* Cas13b (PbCas13b): R53 or R1041; preferably R53A or R53D, or R1041E or R1041D. In some embodiments, one or more mutation of an amino acid corresponding to the following amino acids of *Prevotella buccae* Cas13b (PbCas13b): K457, D397, E398, D399, E400, T405, H407 or D434; preferably D397A, E398A, D399A, E400A, T405A, H407A, H407W, H407Y, H407F or D434A. In some embodiments, in the LID domain one or more mutation of an amino acid corresponding to the following amino acids in the LID domain of *Prevotella buccae* Cas13b (PbCas13b): K457, D397, E398, D399, E400, T405, H407 or D434; preferably D397A, E398A, D399A, E400A, T405A, H407A, H407W, H407Y, H407F or D434A. In some embodiments, the amino acids correspond to the following amino acids of *Prevotella buccae* Cas13b (PbCas13b): amino acids 46-57, 73-79, 152-164, 1036-1046, and 1064-1074. In some embodiments, one or more mutation of an amino acid corresponding to the following amino acids of *Prevotella buccae* Cas13b (PbCas13b): R156, N157, H161, R1068, N1069, and H1073. In some embodiments, one or more mutation of an amino acid corresponding to the following amino acids of *Prevotella buccae* Cas13b (PbCas13b): R285, R287, K292, K294, E296, and N297. In some embodiments, one or more mutation of an amino acid corresponding to the following amino acids of *Prevotella buccae* Cas13b (PbCas13b): K826, K828, K829, R824, R830, Q831, K835, K836, and R838. In some embodiments, one or more mutation of an amino acid corresponding to the following amino acids of *Prevotella buccae* Cas13b (PbCas13b): T405, H407, K457, H500, K570, K590, N634, R638, N652, N653, K655, S658, K741, K744, N756, S757, R762, R791, K846, K857, K870, and R877.

In some embodiments, a mutation of an amino acid corresponding to amino acid T405 of *Prevotella buccae* Cas13b (PbCas13b). In some embodiments, a mutation of an amino acid corresponding to amino acid H407 of *Prevotella buccae* Cas13b (PbCas13b). In some embodiments, a mutation of an amino acid corresponding to amino acid K457 of *Prevotella buccae* Cas13b (PbCas13b). In some embodiments, a mutation of an amino acid corresponding to amino acid H500 of *Prevotella buccae* Cas13b (PbCas13b). In some embodiments, a mutation of an amino acid corresponding to amino acid K570 of *Prevotella buccae* Cas13b (PbCas13b). In some embodiments, a mutation of an amino acid corresponding to amino acid K590 of *Prevotella buccae* Cas13b (PbCas13b).

In some embodiments, a mutation of an amino acid corresponding to amino acid N634 of *Prevotella buccae* Cas13b (PbCas13b). In some embodiments, a mutation of an amino acid corresponding to amino acid R638 of *Prevotella buccae* Cas13b (PbCas13b). In some embodiments, a mutation of an amino acid corresponding to amino acid N652 of *Prevotella buccae* Cas13b (PbCas13b). In some embodiments, a mutation of an amino acid corresponding to amino acid N653 of *Prevotella buccae* Cas13b (PbCas13b). In some embodiments, a mutation of an amino acid corresponding to amino acid K655 of *Prevotella buccae* Cas13b (PbCas13b). In some embodiments, a mutation of an amino acid corresponding to amino acid S658 of *Prevotella buccae* Cas13b (PbCas13b). In some embodiments, a mutation of an amino acid corresponding to amino acid K741 of *Prevotella buccae* Cas13b (PbCas13b). In some embodiments, a mutation of an amino acid corresponding to amino acid K744 of *Prevotella buccae* Cas13b (PbCas13b). In some embodiments, a mutation of an amino acid corresponding to amino acid N756 of *Prevotella buccae* Cas13b (PbCas13b). In some embodiments, a mutation of an amino acid corresponding to amino acid S757 of *Prevotella buccae* Cas13b (PbCas13b). In some embodiments, a mutation of an amino acid corresponding to amino acid R762 of *Prevotella buccae* Cas13b (PbCas13b). In some embodiments, a mutation of an amino acid corresponding to amino acid R791 of *Prevotella buccae* Cas13b (PbCas13b). In some embodiments, a mutation of an amino acid corresponding to amino acid K846 of *Prevotella buccae* Cas13b (PbCas13b). In some embodiments, a mutation of an amino acid corresponding to amino acid K857 of *Prevotella buccae* Cas13b (PbCas13b). In some embodiments, a mutation of an amino acid corresponding to amino acid K870 of *Prevotella buccae* Cas13b (PbCas13b). In some embodiments, a mutation of an amino acid corresponding to amino acid R877 of *Prevotella buccae* Cas13b (PbCas13b). In some embodiments, a mutation of an amino acid corresponding to amino acid K183 of *Prevotella buccae* Cas13b (PbCas13b). In some embodiments, a mutation of an amino acid corresponding to amino acid K193 of *Prevotella buccae* Cas13b (PbCas13b). In some embodiments, a mutation of an amino acid corresponding to amino acid R600 of *Prevotella buccae* Cas13b (PbCas13b). In some embodiments, a mutation of an amino acid corresponding to amino acid K607 of *Prevotella buccae* Cas13b (PbCas13b). In some embodiments, a mutation of an amino acid corresponding to amino acid K612 of *Prevotella buccae* Cas13b (PbCas13b). In some embodiments, a mutation of an amino acid corresponding to amino acid R614 of *Prevotella buccae* Cas13b (PbCas13b). In some embodiments, a mutation of an amino acid corresponding to amino acid K617 of *Prevotella buccae* Cas13b (PbCas13b). In some embodiments, a mutation of an amino acid corresponding to amino acid K826 of *Prevotella buccae* Cas13b (PbCas13b). In some embodiments, a mutation of an amino acid corresponding to amino acid K828 of *Prevotella buccae* Cas13b (PbCas13b). In some embodiments, a mutation of an amino acid corresponding to amino acid K829 of *Prevotella buccae* Cas13b (PbCas13b). In some embodiments, a mutation of an amino acid corresponding to amino acid R824 of *Prevotella buccae* Cas13b (PbCas13b). In some embodiments, a mutation of an amino acid corresponding to amino acid R830 of *Prevotella buccae* Cas13b (PbCas13b). In some embodiments, a mutation of an amino acid corresponding to amino acid Q831 of *Prevotella buccae* Cas13b (PbCas13b). In some embodiments, a mutation of an amino acid corresponding to amino acid K835 of *Prevotella buccae* Cas13b (PbCas13b). In some embodiments, a mutation of an amino acid corresponding to amino acid K836 of *Prevotella buccae* Cas13b (PbCas13b). In some embodiments, a mutation of an amino acid corresponding to amino acid R838 of *Prevotella buccae* Cas13b (PbCas13b). In some embodiments, a mutation of an amino acid corresponding to amino acid R618 of *Prevotella buccae* Cas13b (PbCas13b). In some embodiments, a mutation of an amino acid corresponding to amino acid D434 of *Prevotella buccae* Cas13b (PbCas13b). In some embodiments, a mutation of an amino acid corresponding to amino acid K431 of *Prevotella buccae* Cas13b (PbCas13b). In some embodiments, a mutation of an amino acid corresponding to amino acid R53 of *Prevotella buccae* Cas13b (PbCas13b). In some embodiments, a mutation of an amino acid corresponding to amino acid K943 of *Prevotella buccae* Cas13b (PbCas13b). In some embodiments, a mutation of an amino acid corresponding to amino acid R1041 of *Prevotella buccae* Cas13b (PbCas13b). In some embodiments, a mutation of an amino acid corresponding to amino acid Y164 of *Prevotella buccae* Cas13b (PbCas13b). In some embodiments, a mutation of an amino acid corresponding to amino acid R285 of *Prevotella buccae* Cas13b (PbCas13b). In some embodiments, a mutation of an amino acid corresponding to amino acid R287 of *Prevotella buccae* Cas13b (PbCas13b). In some embodiments, a mutation of an amino acid corresponding to amino acid K292 of *Prevotella buccae* Cas13b (PbCas13b). In some embodiments, a mutation of an amino acid corresponding to amino acid E296 of *Prevotella buccae* Cas13b (PbCas13b). In some embodiments, a mutation of an amino acid corresponding to amino acid N297 of *Prevotella buccae* Cas13b (PbCas13b). In some embodiments, a mutation of an amino acid corresponding to amino acid Q646 of *Prevotella buccae* Cas13b (PbCas13b). In some embodiments, a mutation of an amino acid corresponding to amino acid N647 of *Prevotella buccae* Cas13b (PbCas13b). In some embodiments, a mutation of an amino acid corresponding to amino acid R402 of *Prevotella buccae* Cas13b (PbCas13b). In some embodiments, a mutation of an amino acid corresponding to amino acid K393 of *Prevotella buccae* Cas13b (PbCas13b). In some embodiments, a mutation of an amino acid corresponding to amino acid N653 of *Prevotella buccae* Cas13b (PbCas13b). In some embodiments, a mutation of an amino acid corresponding to amino acid N652 of *Prevotella buccae* Cas13b (PbCas13b). In some embodiments, a mutation of an amino acid corresponding to amino acid R482 of *Prevotella buccae* Cas13b (PbCas13b). In some embodiments, a mutation of an amino acid corresponding to amino acid N480 of *Prevotella buccae* Cas13b (PbCas13b). In some embodiments, a mutation of an amino acid corresponding to amino acid D396 of *Prevotella buccae* Cas13b (PbCas13b). In some embodiments, a mutation of an amino acid corresponding to amino acid E397 of *Prevotella buccae* Cas13b (PbCas13b). In some embodiments, a mutation of an amino acid corresponding to amino acid D398 of *Prevotella buccae* Cas13b (PbCas13b). In some embodiments, a mutation of an amino acid corresponding to amino acid E399 of *Prevotella buccae* Cas13b (PbCas13b). In some embodiments, a mutation of an amino acid corresponding to amino acid K294 of *Prevotella buccae* Cas13b (PbCas13b). In some embodiments, a mutation of an amino acid corresponding to amino acid E400 of *Prevotella buccae* Cas13b (PbCas13b). In some embodiments, a mutation of an amino acid corresponding to amino acid R56 of *Prevotella buccae* Cas13b (PbCas13b). In some embodiments, a mutation of an amino acid corresponding to amino acid N157 of *Prevotella buccae* Cas13b (PbCas13b). In some embodiments, a mutation of an amino acid corresponding to amino acid H161 of *Prevotella buccae* Cas13b (PbCas13b). In some embodiments, a mutation of an amino acid corresponding to amino acid H452 of *Prevotella buccae* Cas13b (PbCas13b). In some embodiments, a mutation of an amino acid corresponding to amino acid N455 of *Prevotella buccae* Cas13b (PbCas13b). In some embodiments, a mutation of an amino acid corresponding to amino acid K484 of *Prevotella buccae* Cas13b (PbCas13b). In some embodiments, a mutation of an amino acid corresponding to amino acid N486 of *Prevotella buccae* Cas13b (PbCas13b). In some embodiments, a mutation of an amino acid corresponding to amino acid G566 of *Prevotella buccae* Cas13b (PbCas13b). In some embodiments, a mutation of an amino acid corresponding to amino acid H567 of *Prevotella buccae* Cas13b (PbCas13b). In some embodiments, a mutation of an amino acid corresponding to amino acid A656 of *Prevotella buccae* Cas13b (PbCas13b). In some embodiments, a mutation of an amino acid corresponding to amino acid V795 of *Prevotella buccae* Cas13b (PbCas13b). In some embodiments, a mutation of an amino acid corresponding to amino acid A796 of *Prevotella buccae* Cas13b (PbCas13b). In some embodiments, a mutation of an amino acid corresponding to amino acid W842 of *Prevotella buccae* Cas13b (PbCas13b). In some embodiments, a mutation of an amino acid corresponding to amino acid K871 of *Prevotella buccae* Cas13b (PbCas13b). In some embodiments, a mutation of an amino acid corresponding to amino acid E873 of *Prevotella buccae* Cas13b (PbCas13b). In some embodiments, a mutation of an amino acid corresponding to amino acid R874 of *Prevotella buccae* Cas13b (PbCas13b). In some embodiments, a mutation of an amino acid corresponding to amino acid R1068 of *Prevotella buccae* Cas13b (PbCas13b). In some embodiments, a mutation of an amino acid corresponding to amino acid N1069 of *Prevotella buccae* Cas13b (PbCas13b). In some embodiments, a mutation of an amino acid corresponding to amino acid H1073 of *Prevotella buccae* Cas13b (PbCas13b).

In some embodiments, one or more mutation of an amino acid corresponding to the following amino acids of *Leptotrichia shahii* Cas13a (LshCas13a): R597, N598, H602, R1278, N1279, or H1283. In some embodiments, one or more mutation of an amino acid corresponding to the following amino acids of *Leptotrichia shahii* Cas13a (LshCas13a): R597, N598, H602, R1278, N1279, or H1283. In some embodiments, in a HEPN domain one or more mutation of an amino acid corresponding to the following amino acids in a HEPN domain of *Leptotrichia shahii* Cas13a (LshCas13a): R597, N598, H602, R1278, N1279, or H1283. In some embodiments, one or more mutation of an amino acid corresponding to the following amino acids of *Leptotrichia shahii* Cas13a (LshCas13a): R597, N598, or H602. In some embodiments, in HEPN domain 1 one or more mutation of an amino acid corresponding to the following amino acids in HEPN domain 1 of *Leptotrichia shahii* Cas13a (LshCas13a): R597, N598, or H602. In some embodiments, one or more mutation of an amino acid corresponding to the following amino acids of *Leptotrichia shahii* Cas13a (LshCas13a): R1278, N1279, or H1283. In some embodiments, in HEPN domain 2 one or more mutation of an amino acid corresponding to the following amino acids in HEPN domain 2 of *Leptotrichia shahii* Cas13a (LshCas13a): R1278, N1279, or H1283. In some embodiments, one or more mutation of an amino acid corresponding to the following amino acids of *Porphyromonas gulae* Cas13b (PguCas13b): R146, H151, R1116, or H1121. In some embodiments, one or more mutation of an amino acid corresponding to the following amino acids of *Porphyromonas gulae* Cas13b (PguCas13b): R146, H151, R1116, or H1121. In some embodiments, in a HEPN domain one or more mutation of an amino acid corresponding to the following amino acids in a HEPN domain of *Porphyromonas gulae* Cas13b (PguCas13b): R146, H151, R1116, or H1121. In some embodiments, one or more mutation of an amino acid corresponding to the following amino acids of *Porphyromonas gulae* Cas13b (PguCas13b): R146 or H151. In some embodiments, in HEPN domain 1 one or more mutation of an amino acid corresponding to the following amino acids in HEPN domain 1 of *Porphyromonas gulae* Cas13b (PguCas13b): R146 or H151. In some embodiments, one or more mutation of an amino acid corresponding to the following amino acids of *Porphyromonas gulae* Cas13b (PguCas13b): R1116 or H1121. In some embodiments, in HEPN domain 2 one or more mutation of an amino acid corresponding to the following amino acids in HEPN domain 2 of *Porphyromonas gulae* Cas13b (PguCas13b): R1116 or H1121. In some embodiments, one or more mutation of an amino acid corresponding to the following amino acids of *Prevotella* sp. P5-125 Cas13b (PspCas13b): H133 or H1058. In some embodiments, one or more mutation of an amino acid corresponding to the following amino acids of *Prevotella* sp. P5-125 Cas13b (PspCas13b): H133 or H1058. In some embodiments, in a HEPN domain one or more mutation of an amino acid corresponding to the following amino acids in a HEPN domain of *Prevotella* sp. P5-125 Cas13b (PspCas13b): H133 or H1058. In some embodiments, a mutation of an amino acid corresponding to amino acid H133 of *Prevotella* sp. P5-125 Cas13b (PspCas13b). In some embodiments, in HEPN domain 1 a mutation of an amino acid corresponding to amino acid H133 in HEPN domain 1 of *Prevotella* sp. P5-125 Cas13b (PspCas13b). In some embodiments, a mutation of an amino acid corresponding to amino acid H1058 of *Prevotella* sp. P5-125 Cas13b (PspCas13b). In some embodiments, in HEPN domain 2 a mutation of an amino acid corresponding to the amino acid H1058 in HEPN domain 2 of *Prevotella* sp. P5-125 Cas13b (PspCas13b).

In some embodiments, the amino acid is mutated to A, P, or V, preferably A. In some embodiments, said amino acid is mutated to a hydrophobic amino acid. In some embodiments, said amino acid is mutated to an aromatic amino acid. In some embodiments, said amino acid is mutated to a charged amino acid. In some embodiments, said amino acid is mutated to a positively charged amino acid. In some embodiments, said amino acid is mutated to a negatively charged amino acid. In some embodiments, said amino acid is mutated to a polar amino acid. In some embodiments, said amino acid is mutated to an aliphatic amino acid. In some embodiments, the engineered CRISPR-Cas protein further comprises a functional heterologous domain.

In some embodiments, the Cas13 protein is from a species of the genus *Alistipes, Anaerosalibacter, Bacteroides, Bacteroidetes, Bergeyella, Blautia, Butyrivibrio, Capnocytophaga, Carnobacterium, Chloroflexus, Chryseobacterium, Clostridium, Demequina, Eubacteriaceae, Eubacterium, Flavobacterium, Fusobacterium, Herbinix, Insolitispirillum, Lachnospiraceae, Leptotrichia, Listeria, Myroides, Paludibacter, Phaeodactylibacter, Porphyromonadaceae, Porphyromonas, Prevotella, Pseudobutyrivibrio, Psychroflexus, Reichenbachiella, Rhodobacter, Riemerella, Sinomicrobium, Thalassospira, Ruminococcus*; preferably *Leptotrichia shahii, Listeria seeligeri, Lachnospiraceae*

*bacterium* (such as Lb MA2020, Lb NK4A179, Lb NK4A144), *Clostridium aminophilum* (such as Ca DSM 10710), *Carnobacterium gallinarum* (such as Cg DSM 4847), *Paludibacter propionicigenes* (such as Pp WB4), *Listeria weihenstephanensis* (such as Lw FSL R9-0317), *Listeriaceae bacterium* (such as Lb FSL M6-0635), *Leptotrichia wadei* (such as Lw F0279), *Rhodobacter capsulatus* (such as Rc SB 1003, Rc R121, Rc DE442), *Leptotrichia buccalis* (such as Lb C-1013-b), *Herbinix hemicellulosilytica, Eubacteriaceae bacterium* (such as Eb CHKCI004), *Blautia*. sp Marseille-P2398, *Leptotrichia* sp. oral taxon 879 str. F0557, *Chloroflexus aggregans, Demequina aurantiaca, Thalassospira* sp. TSL5-1, *Pseudobutyrivibrio* sp. OR37, *Butyrivibrio* sp. YAB3001, *Leptotrichia* sp. Marseille-P3007, *Bacteroides ihuae, Porphyromonadaceae bacterium* (such as Pb KH3CP3RA), *Listeria riparia, Insolitispirillum peregrinum, Alistipes* sp. ZOR0009, *Bacteroides pyogenes* (such as Bp F0041), *Bacteroidetes bacterium* (such as Bb GWA2_31_9), *Bergeyella zoohelcum* (such as Bz ATCC 43767), *Capnocytophaga canimorsus, Capnocytophaga cynodegmi, Chryseobacterium carnipullorum, Chryseobacterium jejuense, Chryseobacterium ureilyticum, Flavobacterium branchiophilum, Flavobacterium columnare, Flavobacterium* sp. 316, *Myroides odoratimimus* (such as Mo CCUG 10230, Mo CCUG 12901, Mo CCUG 3837), *Paludibacter propionicigenes, Phaeodactylibacter xiamenensis, Porphyromonas gingivalis* (such as Pg F0185, Pg F0568, Pg JCVI SC001, Pg W4087, *Porphyromonas gulae, Porphyromonas* sp. COT-052 OH4946, *Prevotella aurantiaca, Prevotella buccae* (such as Pb ATCC 33574), *Prevotella falsenii, Prevotella intermedia* (such as Pi 17, Pi ZT), *Prevotella pallens* (such as Pp ATCC 700821), *Prevotella pleuritidis, Prevotella saccharolytica* (such as Ps F0055), *Prevotella* sp. MA2016, *Prevotella* sp. MSX73, *Prevotella* sp. P4-76, *Prevotella* sp. P5-119, *Prevotella* sp. P5-125, *Prevotella* sp. P5-60, *Psychroflexus torquis, Reichenbachiella agariperforans, Riemerella anatipestifer, Sinomicrobium oceani, Fusobacterium necrophorum* (such as Fn subsp. *funduliforme* ATCC 51357, Fn DJ-2, Fn BFTR-1, Fn subsp. *Funduliforme*), *Fusobacterium perfoetens* (such as Fp ATCC 29250), *Fusobacterium ulcerans* (such as Fu ATCC 49185), *Anaerosalibacter* sp. ND1, *Eubacterium siraeum, Ruminococcus flavefaciens* (such as Rfx XPD3002), or *Ruminococcus albus.*

In some embodiments, the Cas13 protein is a Cas13a protein.

In some embodiments, the Cas13a protein is from a species of the genus *Bacteroides, Blautia, Butyrivibrio, Carnobacterium, Chloroflexus, Clostridium, Demequina, Eubacterium, Herbinix, Insolitispirillum, Lachnospiraceae, Leptotrichia, Listeria, Paludibacter, Porphyromonadaceae, Pseudobutyrivibrio, Rhodobacter*, or *Thalassospira*; preferably *Leptotrichia shahii, Listeria seeligeri, Lachnospiraceae bacterium* (such as Lb MA2020, Lb NK4A179, Lb NK4A144), *Clostridium aminophilum* (such as Ca DSM 10710), *Carnobacterium gallinarum* (such as Cg DSM 4847), *Paludibacter propionicigenes* (such as Pp WB4), *Listeria weihenstephanensis* (such as Lw FSL R9-0317), *Listeriaceae bacterium* (such as Lb FSL M6-0635), *Leptotrichia wadei* (such as Lw F0279), *Rhodobacter capsulatus* (such as Rc SB 1003, Rc R121, Rc DE442), *Leptotrichia buccalis* (such as Lb C-1013-b), *Herbinix hemicellulosilytica, Eubacteriaceae bacterium* (such as Eb CHKCI004), *Blautia*. sp Marseille-P2398, *Leptotrichia* sp. oral taxon 879 str. F0557, *Chloroflexus aggregans, Demequina aurantiaca, Thalassospira* sp. TSL5-1, *Pseudobutyrivibrio* sp. OR37, *Butyrivibrio* sp. YAB3001, *Leptotrichia* sp. Marseille-P3007, *Bacteroides ihuae, Porphyromonadaceae bacterium* (such as Pb KH3CP3RA), *Listeria riparia*, or *Insolitispirillum peregrinum.*

In some embodiments, the Cas13 protein is a Cas13b protein.

In some embodiments, the Cas13b protein is from a species of the genus *Alistipes, Bacteroides, Bacteroidetes, Bergeyella, Capnocytophaga, Chryseobacterium, Flavobacterium, Myroides, Paludibacter, Phaeodactylibacter, Porphyromonas, Prevotella, Psychroflexus, Reichenbachiella, Riemerella, or Sinomicrobium*; preferably *Alistipes* sp. ZOR0009, *Bacteroides pyogenes* (such as Bp F0041), *Bacteroidetes bacterium* (such as Bb GWA2_31_9), *Bergeyella zoohelcum* (such as Bz ATCC 43767), *Capnocytophaga canimorsus, Capnocytophaga cynodegmi, Chryseobacterium carnipullorum, Chryseobacterium jejuense, Chryseobacterium ureilyticum, Flavobacterium branchiophilum, Flavobacterium columnare, Flavobacterium* sp. 316, *Myroides odoratimimus* (such as Mo CCUG 10230, Mo CCUG 12901, Mo CCUG 3837), *Paludibacter propionicigenes, Phaeodactylibacter xiamenensis, Porphyromonas gingivalis* (such as Pg F0185, Pg F0568, Pg JCVI SC001, Pg W4087, *Porphyromonas gulae, Porphyromonas* sp. COT-052 OH4946, *Prevotella aurantiaca, Prevotella buccae* (such as Pb ATCC 33574), *Prevotella falsenii, Prevotella intermedia* (such as Pi 17, Pi ZT), *Prevotella pallens* (such as Pp ATCC 700821), *Prevotella pleuritidis, Prevotella saccharolytica* (such as Ps F0055), *Prevotella* sp. MA2016, *Prevotella* sp. MSX73, *Prevotella* sp. P4-76, *Prevotella* sp. P5-119, *Prevotella* sp. P5-125, *Prevotella* sp. P5-60, *Psychroflexus torquis, Reichenbachiella agariperforans, Riemerella anatipestifer*, or *Sinomicrobium oceani.*

In some embodiments, the Cas13 protein is a Cas13c protein.

In some embodiments, the Cas13c protein is from a species of the genus *Fusobacterium* or *Anaerosalibacter*; preferably *Fusobacterium necrophorum* (such as Fn subsp. *funduliforme* ATCC 51357, Fn DJ-2, Fn BFTR-1, Fn subsp. *Funduliforme*), *Fusobacterium perfoetens* (such as Fp ATCC 29250), *Fusobacterium ulcerans* (such as Fu ATCC 49185), or *Anaerosalibacter* sp. ND1.

In some embodiments, the Cas13 protein is a Cas13d protein.

In some embodiments, the Cas13d protein is from a species of the genus *Eubacterium* or *Ruminococcus*, preferably *Eubacterium siraeum, Ruminococcus flavefaciens* (such as Rfx XPD3002), or *Ruminococcus albus.*

In some embodiments, the catalytic activity of the engineered CRISPR-Cas protein is increased as compared to a corresponding wildtype CRISPR-Cas protein. In some embodiments, the catalytic activity of the engineered CRISPR-Cas protein is decreased as compared to a corresponding wildtype CRISPR-Cas protein. In some embodiments, the gRNA binding of the engineered CRISPR-Cas protein is increased as compared to a corresponding wildtype CRISPR-Cas protein. In some embodiments, the gRNA binding of the engineered CRISPR-Cas protein is decreased as compared to a corresponding wildtype CRISPR-Cas protein. In some embodiments, the specificity of the CRISPR-Cas protein is increased as compared to a corresponding wildtype CRISPR-Cas protein. In some embodiments, the specificity of the CRISPR-Cas protein is decreased as compared to a corresponding wildtype CRISPR-Cas protein. In some embodiments, the stability of the CRISPR-Cas protein is increased as compared to a corresponding wildtype CRISPR-Cas protein. In some embodiments, the stability of the CRISPR-Cas protein is decreased as compared to a corresponding wildtype CRISPR-Cas protein. In some embodiments, the engineered CRISPR-Cas protein further comprises one or more mutations which inactivate catalytic activity. In some embodiments, the off-target binding of the CRISPR-Cas protein is increased as compared to a corresponding wildtype CRISPR-Cas protein. In some embodiments, the off-target binding of the CRISPR-Cas protein is decreased as compared to a corresponding wildtype CRISPR-Cas protein. In some embodiments, the target binding of the CRISPR-Cas protein is increased as compared to a corresponding wildtype CRISPR-Cas protein. In some embodiments, the target binding of the CRISPR-Cas protein is decreased as compared to a corresponding wildtype CRISPR-Cas protein. In some embodiments, the engineered CRISPR-Cas protein has a higher protease activity or polynucleotide-binding capability compared with a corresponding wildtype CRISPR-Cas protein. In some embodiments, PFS recognition is altered as compared to a corresponding wildtype CRISPR-Cas protein. In some embodiments, the engineered CRISPR-Cas protein further comprises a functional heterologous domain. In some embodiments, the engineered CRISPR-Cas protein further comprises an NLS.

In another aspect, the present disclosure provides one or more HEPN domains and is less than 1000 amino acids in length. In some embodiments, the protein is less than 950, less than 900, less than 850, less than 800, less, or than 750 amino acids in size. In some embodiments, the HEPN domain comprises RxxxxH motif sequence. In some embodiments, the RxxxxH motif comprises a R[N/H/K] $X_1X_2X_3$H sequence. In some embodiments, $X_1$ is R, S, D, E, Q, N, G, or Y, $X_2$ is independently I, S, T, V, or L, and $X_3$ is independently L, F, N, Y, V, I, S, D, E, or A. In some embodiments, the CRISPR-Cas protein is a Type VI CRISPR Cas protein. In some embodiments, the Type VI CRISPR Cas protein is a Cas13a, a Cas13b, a Cas13c, or a Cas13d. In some embodiments, the CRISPR-Cas protein is associated with a functional domain. In some embodiments, the CRISPR-Cas protein comprises one or more mutations equivalate to mutations described herein. In some embodiments, the CRISPR-Cas protein comprises one or more mutations in the helical domain. In some embodiments, the CRISPR-Cas protein is in a dead form or has nickase activity.

In another aspect, the present disclosure provides a polynucleic acid encoding the engineered CRISPR-Cas protein herein. In some embodiments, the polynucleic acid is codon optimized.

In another aspect, the present disclosure provides a CRISPR-Cas system comprising the engineered CRISPR-Cas protein herein or the polynucleotide herein, and a nucleotide component capable of forming a complex with the engineered CRISPR-Cas protein and able to hybridize with a target nucleic acid sequence and direct sequence-specific binding of said complex to the target nucleic acid sequence.

In another aspect, the present disclosure provides a vector system comprising one or more vectors, the one or more vectors comprising one or more polynucleotide molecules encoding components of the engineered CRISPR-Cas protein.

In another aspect, the present disclosure provides a method of modifying a target nucleic acid comprising: introducing in a cell or organism that comprises the target nucleic acid, the engineered CRISPR-Cas protein, the polynucleotide, the CRISPR-Cas system, or the vector or vector system described herein, such that the engineered CRISPR-Cas protein modifies the target nucleic acid in the cell or organism.

In some embodiments, the engineered CRISPR-Cas system is introduced via delivery by liposomes, nanoparticles, exosomes, microvesicles, nucleic acid nanoassemblies, a gene gun, an implantable device, or the vector system herein. In some embodiments, the engineered CRISPR-cas protein is associated with one or more functional domains. In some embodiments, the target nucleic acid comprises a genomic locus, and the engineered CRISPR-Cas protein modifies gene product encoded at the genomic locus or expression of the gene product. In some embodiments, the target nucleic acid is DNA or RNA and wherein one or more nucleotides in the target nucleic acid are base edited. In some embodiments, the target nucleic acid is DNA or RNA and wherein the target nucleic acid is cleaved. In some embodiments, the engineered CRISPR-Cas protein further cleaves non-target nucleic acid. In some embodiments, the method further comprises visualizing activity and, optionally, using a detectable label. In some embodiments, the method further comprises detecting binding of one or more components of the CRISPR-Cas system to the target nucleic acid. In some embodiments, said cell or organisms is a eukaryotic cell or organism. In some embodiments, said cell or organisms is an animal cell or organism. In some embodiments, said cell or organisms is a plant cell or organism.

In another aspect, the present disclosure provides method for detecting a target nucleic acid in a sample comprising: contacting a sample with: an engineered CRISPR-Cas protein herein; at least one guide polynucleotide comprising a guide sequence capable of binding to the target nucleic acid and designed to form a complex with the engineered CRISPR-Cas; and a RNA-based masking construct comprising a non-target sequence; wherein the engineered CRISPR-Cas protein exhibits collateral RNase activity and cleaves the non-target sequence of the detection construct; and detecting a signal from cleavage of the non-target sequence, thereby detecting the target nucleic acid in the sample.

In some embodiments, the method further comprises contacting the sample with reagents for amplifying the target nucleic acid. In some embodiments, the reagents for amplifying comprises isothermal amplification reaction reagents. In some embodiments, the isothermal amplification reagents comprise nucleic-acid sequence-based amplification, recombinase polymerase amplification, loop-mediated isothermal amplification, strand displacement amplification, helicase-dependent amplification, or nicking enzyme amplification reagents. In some embodiments, the target nucleic acid is DNA molecule and the method further comprises contacting the target DNA molecule with a primer comprising an RNA polymerase site and RNA polymerase. In some embodiments, the masking construct: suppresses generation of a detectable positive signal until the masking construct cleaved or deactivated, or masks a detectable positive signal or generates a detectable negative signal until the masking construct cleaved or deactivated.

In some embodiments, the masking construct comprises: a. a silencing RNA that suppresses generation of a gene product encoded by a reporting construct, wherein the gene product generates the detectable positive signal when expressed; b. a ribozyme that generates the negative detectable signal, and wherein the positive detectable signal is generated when the ribozyme is deactivated; or c. a ribozyme that converts a substrate to a first color and wherein the substrate converts to a second color when the ribozyme is deactivated; d. an aptamer and/or comprises a polynucleotide-tethered inhibitor; e. a polynucleotide to which a detectable ligand and a masking component are attached; f. a nanoparticle held in aggregate by bridge molecules, wherein at least a portion of the bridge molecules comprises a polynucleotide, and wherein the solution undergoes a color shift when the nanoparticle is disbursed in solution; g. a quantum dot or fluorophore linked to one or more quencher molecules by a linking molecule, wherein at least a portion of the linking molecule comprises a polynucleotide; h. a polynucleotide in complex with an intercalating agent, wherein the intercalating agent changes absorbance upon cleavage of the polynucleotide; or l. two fluorophores tethered by a polynucleotide that undergo a shift in fluorescence when released from the polynucleotide.

In some embodiments, the aptamer a. comprises a polynucleotide-tethered inhibitor that sequesters an enzyme, wherein the enzyme generates a detectable signal upon release from the aptamer or polynucleotidetethered inhibitor by acting upon a substrate; or b. is an inhibitory aptamer that inhibits an enzyme and prevents the enzyme from catalyzing generation of a detectable signal from a substrate or wherein the polynucleotidetethered inhibitor inhibits an enzyme and prevents the enzyme from catalyzing generation of a detectable signal from a substrate; or c. sequesters a pair of agents that when released from the aptamers combine to generate a detectable signal. In some embodiments, the nanoparticle is a colloidal metal. In some embodiments, the at least one guide polynucleotide comprises a mismatch. In some embodiments, the mismatch is up- or downstream of a single nucleotide variation on the one or more guide sequences.

In another aspect, the present disclosure provides a cell or organism comprising the engineered CRISPR-Cas protein herein, the polynucleic acid herein, the CRISPR-Cas system, or the vector or vector system herein.

In another aspect, the present disclosure provides an engineered adenosine deaminase comprising one or more mutations, wherein the engineered adenosine deaminase has cytidine deaminase activity.

In some embodiments, the engineered adenosine deaminase has adenosine deaminase activity. In some embodiments, the engineered adenosine deaminase is a portion of a fusion protein. In some embodiments, the fusion protein comprises a functional domain. In some embodiments, the functional domain is capable of directing the engineered adenosine deaminase to bind to a target nucleic acid. In some embodiments, the functional domain is a CRISPR-Cas protein herein. In some embodiments, the CRISPR-Cas protein is a dead form CRISPR-Cas protein or CRISPR-Cas nickase protein. In some embodiments, the one or more mutations comprises: E488Q, V351G, S486A, T375S, S370C, P462A, N597I, L332I, I398V, K350I, M383L, D619G, S582T, V440I, S495N, K418E, S661T based on amino acid sequence positions of hADAR2-D, and corresponding mutations in a homologous ADAR protein. In some embodiments, the one or more mutations comprises: E488Q, V351G, S486A, T375S, S370C, P462A, N597I, L332I, I398V, K350I, M383L, D619G, S582T, V440I, S495N, K418E, and S661T based on amino acid sequence positions of hADAR2-D, and corresponding mutations in a homologous ADAR protein.

In another aspect, the present disclosure provides a polynucleotide encoding the engineered adenosine deaminase, or a catalytic domain thereof. In another aspect, the present disclosure provides comprising the polynucleotide.

In another aspect, the present disclosure provides a pharmaceutical composition comprising the engineered adenosine deaminase or a catalytic domain thereof formulated for delivery by liposomes, nanoparticles, exosomes, microvesicles, nucleic acid nanoassemblies, a gene gun, or an implantable device.

In another aspect, the present disclosure an engineered cell expressing the engineered adenosine deaminase or a catalytic domain thereof. In some embodiments, the cell transiently expresses the engineered adenosine deaminase or the catalytic domain thereof. In some embodiments, the cell non-transiently expresses the engineered adenosine deaminase or the catalytic domain thereof.

An another aspect, the present disclosure provides an engineered, non-naturally occurring system for modifying nucleotides in a target nucleic acid, comprising a) a dead CRISPR-Cas or CRISPR-Cas nickase protein, or a nucleotide sequence encoding said dead Cas or Cas nickase protein; b) a guide molecule comprising a guide sequence that hybridizes to a target sequence and designed to form a complex with the dead CRISPR-Cas or CRISPR-Cas nickase protein; and c) a nucleotide deaminase protein or catalytic domain thereof, or a nucleotide sequence encoding said nucleotide deaminase protein or catalytic domain thereof, wherein said nucleotide deaminase protein or catalytic domain thereof is covalently or non-covalently linked to said dead CRISPR-Cas or CRISPR-Cas nickase protein or said guide molecule is adapted to link thereof after delivery.

In some embodiments, said adenosine deaminase protein or catalytic domain thereof comprises one or more of the mutations: E488Q, V351G, S486A, T375S, S370C, P462A, N597I, L332I, I398V, K350I, M383L, D619G, S582T, V440I, S495N, K418E, S661T based on amino acid sequence positions of hADAR2-D, and corresponding mutations in a homologous ADAR protein. In some embodiments, said adenosine deaminase protein or catalytic domain thereof comprises mutations: E488Q, V351G, S486A, T375S, S370C, P462A, N597I, L332I, I398V, K350I, M383L, D619G, S582T, V440I, S495N, K418E, and S661T based on amino acid sequence positions of hADAR2-D, and corresponding mutations in a homologous ADAR protein.

In some embodiments, the CRISPR-Cas protein is Cas9, Cas12, Cas13, Cas 14, CasX, CasY. In some embodiments, the CRISPR-Cas protein is Cas13b. In some embodiments, the CRISPR-Cas protein is Cas13b-t1, Cas13b-t2, or Cas13b-t3. In some embodiments, the CRISPR-Cas is an engineered CRISPR-Cas protein.

In another aspect, the present disclosure provides a method for modifying nucleotide in a target nucleic acid, comprising: delivering to said target nucleic acid the engineered adenosine deaminase, or the system, wherein the deaminase deaminates a nucleotide at one or more target loci on the target nucleic acid.

In some embodiments, said nucleotide deaminase protein or catalytic domain thereof has been modified to increase activity against a DNA-RNA heteroduplex. In some embodiments, said nucleotide deaminase protein or catalytic domain thereof has been modified to reduce off-target effects. In some embodiments, the target nucleic acid is within a cell. In some embodiments, said cell is a eukaryotic cell. In some embodiments, said cell is a non-human animal cell. In some embodiments, said cell is a human cell. In some embodiments, said cell is a plant cell. In some embodiments, said target nucleic acid is within an animal. In some embodiments, said target nucleic acid is within a plant. In some embodiments, said target nucleic acid is comprised in a DNA molecule in vitro. In some embodiments, the engineered adenosine deaminase, or one or more components of the system are delivered to the cell as a ribonucleoprotein complex. In some embodiments, the engineered adenosine deaminase, or one or more components of the system are delivered via one or more particles, one or more vesicles, or one or more viral vectors. In some embodiments, said one or more particles comprise a lipid, a sugar, a metal or a protein. In some embodiments, said one or more particles comprise lipid nanoparticles. In some embodiments, said one or more vesicles comprise exosomes or liposomes. In some embodiments, said one or more viral vectors comprise one or more adenoviral vectors, one or more lentiviral vectors, or one or more adeno-associated viral vectors. In some embodiments, said method modifies a cell, a cell line or an organism by manipulation of one or more target sequences at genomic loci of interest. In some embodiments, said deamination of said nucleotide at said target locus of interest remedies a disease caused by a G→A or C→T point mutation or a pathogenic SNP. In some embodiments, said disease is selected from cancer, haemophilia, beta-thalassemia, Marfan syndrome and Wiskott-Aldrich syndrome. In some embodiments, said deamination of said nucleotide at said target locus of interest remedies a disease caused by a T→C or A→G point mutation or a pathogenic SNP. In some embodiments, said deamination of said nucleotide at said target locus of interest inactivates a target gene at said target locus. In some embodiments, the engineered adenosine deaminase, or one or more components of the system are delivered by liposomes, nanoparticles, exosomes, microvesicles, nucleic acid nanoassemblies, a gene gun, an implantable device, or the vector system. In some embodiments, modification of the nucleotide modifies gene product encoded at the target locus or expression of the gene product.

These and other aspects, objects, features, and advantages of the example embodiments will become apparent to those having ordinary skill in the art upon consideration of the following detailed description of illustrated example embodiments.

BRIEF DESCRIPTION OF THE DRAWINGS

An understanding of the features and advantages of the present invention will be obtained by reference to the following detailed description that sets forth illustrative embodiments, in which the principles of the invention may be utilized, and the accompanying drawings of which:

(FIG. 1A) Linear domain organization of PbuCas13b. Active site positioning is denoted by asterisks. (FIG. 1B) crRNA hairpin in complex with PbuCas13b. (FIG. 1C) Overall structure of PbuCas13b. Two views are rotated 180 degrees from each other. Domains are colored consistent with the linear domain map. crRNA is colored red. (FIG. 1D) Space-filling model of PbuCas13b, each view rotated 180 degrees from each other.

(FIG. 2A) Diagram of PbCas13b crRNA (SEQ ID NO:1). Direct repeat residues are colored red, and spacer residues in light blue. (FIG. 2B) Positioning of the 3' end of the crRNA near K393 and coordinating residues within PbuCas13b. (FIG. 2C) Structure of the crRNA within the PbuCas13b complex. Coloring is consistent with panel (FIG. 2A). (FIG. 2D) Base identity swapping. Upper panel, nuclease activity; lower panel, thermal stability. Hashed fill denotes wild type base identities. (FIG. 2E) Mutagenesis of Lid domain residues that coordinate and process crRNA within PbuCas13b. Upper panel, RNase activity in SHERLOCK reaction; lower panel, crRNA processing. Cleavage bands and expected sizes are indicated by red markers, ladder with sizes are shown on left.

(FIG. 4A) Linear comparison of domain organization of PbuCas13b and LshCas13a (pdb 5wtk). crRNAs are shown to the right. (FIG. 4B) Two views of PbuCas13b rotated 90 degrees. Inset is zoomed in on active site residues in the same orientation as in (FIG. 4C). (FIG. 4C) LshCas13a colored consistently with (FIG. 4A). Homologous residues are labeled.

(FIG. 5A) Effect of all PbuCas13b site-directed mutations on RNA interference in mammalian cells. Strongest interference knockdowns are colored in light blue. (FIG. 5B) PbuCas13b with strong mutations labeled and colored in red. (FIGS. 5C-5H) Mutations separated by region.

(FIG. 6A) Surface electrostatics of PbuCas13b. (FIG. 6B) Surface electrostatics of PbuCas13b rotated 180 degrees from panel A. (FIG. 6C) Surface electrostatics of PbuCas13b with the Lid domain removed, showing the inner positively charged channel. (FIG. 6D) Surface electrostatics of the putative crRNA processing active site.

(FIG. 8A) PbuCas13b direct repeat structure. (FIG. 8B) Ideal A-form RNA. (FIG. 8C) Diagram of direct repeat base pairing and secondary structure (SEQ ID NO:3). (FIG. 8D) Multiplete one. (FIG. 8E) Multiplete two. (FIG. 8F) Multiplete three. (FIG. 8G) Alignment of PbuCas13b direct repeat sequences (SEQ ID NOs:4-9). Asterix denote conserved nucleotides.

(FIG. 10A) Schematic of crRNA substrate for processing assay (SEQ ID NOs:10-11). (FIG. 10B) Gel showing complementary DR is not processed. (FIG. 10C) crRNA processing by mutants of PbuCas13b. (FIG. 10D) SHERLOCK assay measuring general RNase activity.

(FIG. 11A) The effect of RNA substrate on PbuCas13b thermal stability. (FIG. 11B) The effect of PbuCas13b RNA cleavage and thermal stability. (FIG. 11C) The effect of magnesium on PbuCas13b thermal stability.

(FIG. 17A) crRNA processing gel1. (FIG. 17B) crRNA processing gel2. (FIG. 17C) crRNA processing gel3. (FIG. 17D) limited proteolysis gel.

FIG. 24 shows validation of RESCUEv9's effect on C-flip guides.

FIG. 41 shows multiplexed on/off-target guides for screening (SEQ ID NOs:38-39).

FIG. 42A shows validation of RESCUEv10 (Rounds 50, 52). FIG. 42B shows validation of RESCUEv10 (Rounds 53, 54). FIG. 42C shows validation of RESCUEv10 (Rounds 58). FIG. 42D shows validation of RESCUEv10 (Rounds 59). FIG. 42E shows validation of RESCUEv10 (Rounds 61).

FIG. 57 shows a summary of RESCUE mutations screened.

(FIG. 73A) Schematic of the directed evolution approach, involving rational mutagenesis, yeast screening, and mammalian cell validation of activity. (FIG. 73B) Activity of RESCUE versions 0-16 on a cytidine flanked by a 5' U and a C' G on a Gluc transcript. Left: Luciferase reporter activity is reported for RESCUEv0-v16. Right: Percent editing levels of RESCUEv0-v16 is reported. (FIG. 73C) Heatmap depicting the percent editing levels of RESCUEv0-v16 on cytidines flanked by varying bases on the Gluc transcript. (FIG. 73D) Percent editing of RESCUEv0-v16 on a cytidine flanked by a 5' U and a C' G on a Glue transcript at varying levels of the RESCUE plasmid transfected. (FIG. 73E) Editing activity of RESCUEv16 and RESCUEv8 on all possible 16 cytidine flanking bases motifs on the Gluc transcript. Guide designs with either a T-flip or a C-flip across from the target cytidine are used. (FIG. 73F) Cytidine deamination by RESCUEv16 is compared to editing with the guide RNA along with either ADAR2dd, full length ADAR2, or no protein. (FIG. 73G) A zoomed in crystal structure view of the mutants at the catalytic deamination site with the RNA with the flipped out base also shown.

(FIG. 74A) Editing efficiency of RESCUEv16 on a panel of endogenous genes covering multiple motifs. (FIG. 74B) Heatmap depicting editing efficiency of RESCUE versions v0-v16 on a panel of three endogenous genes. (FIG. 74C) Editing efficiency of RESCUEv16 on a set of synthetic versions of relevant T>C disease mutations. (FIG. 74D) Schematic of multiplexed C to U and A to I editing with pre-crRNA guide arrays. (FIG. 74E) Simultaneous C to U and A to I editing on beta catenin transcripts. (FIG. 74F) Schematic of rational prevention of off-target activity at neighboring adenosine sites via introduction of disfavored base flips (SEQ ID NO:65-66). (FIG. 74G) Percent editing at on-target C and off-target A sites for *Gaussia* luciferase (left) and KRAS (right) using rational introduction of disfavored baseflips.

(FIG. 75A) On-target C to U editing and summary of C to U and A to I transcriptome-wide off targets of RESCUE v16 and B6-REPAIRv1, B12-REPAIRv1, and B12-REPAIRv2. (FIG. 75B) Manhattan plot of RESCUEv16 A to I and C to U off targets. The on-target C to U edit is highlighted in orange. (FIG. 75C) Schematic of the interactions between ADAR2dd residues and double stranded RNA substrate with residues used in a mutagenesis screen for improving specificity highlighted red (SEQ ID NO:67-68). (FIG. 75D) Luciferase values for C to U activity with a targeting guide (y-axis) and A to I activity with a non-targeting guide (x-axis) shown for RESCUEv16 and 95 RESCUEv16 mutants. Mutants highlighted in blue have efficient targeted C to U activity, but have lost their residual A to I activity, indicating an improvement in A to I specificity. (FIG. 75E) On-target C to U editing and summary of C to U and A to I transcriptome-wide off targets of RESCUE v16 and top specificity mutants. (FIG. 75F) Manhattan plot of RESCUEv16S (+S375A) A to I and C to U off targets (SEQ ID NO:65-66). The on-target C to U edit is highlighted in orange.

(FIG. 76A) Schematic of RNA targeting against phosphorylated residues of STAT3 to alter associated signaling pathways (SEQ ID NO:69-74). (FIG. 76B) Percent editing at relevant phosphorylated residues in STAT3 (left) and STAT1 (right) by RESCUEv16. (FIG. 76C) Inhibition of STAT3 (left) and STAT1 (right) signaling by RNA editing as measured by STAT-driven luciferase expression. (FIG. 76D) Schematic of RNA targeting against phosphorylated residues of CTNNB1 to promote stabilization (SEQ ID NO:75-77). (FIG. 76E) Schematic of beta catenin activation via editing of phosphorylated residues by RESCUE, resulting in increased cellular growth. (FIG. 76F) Percent editing at relevant phosphorylated residues in CTNNB1 by RESCUEv16. (FIG. 76G) Activation of CTNNB1 signaling by RNA editing as measured by CTNNB1-driven (TCF/LEF) luciferase expression. (FIG. 76H) Quantitation of cellular growth due to activation of CTNNB1 signaling by RNA editing.

(FIG. 77A) Luciferase activity of a panel of various Gluc mutants shown to previously have some effect on luciferase activity [cite Gluc paper]. Values represent mean+/−S.E.M (n=3). (FIG. 77B) Luciferase activity of a panel of leucine to proline Gluc mutants. Leucine to proline mutant reporters were focused on because they generate a CCN motif site for cytidine deamination (center C is deaminated). This allows for assaying the effect of all four CCN motifs on RESCUE deamination activity. Values represent mean+/−S.E.M (n=3).

(FIG. 78A) Dose response of RESCUEv0-v16 activity as measured by restoration of luciferase activity on a UCG site in the Gluc transcript. Values represent mean of three replicates. (FIG. 78B) Dose response of RESCUEv0-v16 activity as measured by restoration of luciferase activity on the T41I site in the CTNNB1 transcript. Values represent mean of three replicates.

(FIG. 84A) Percent fluorescence correction of the GFP mutation Y66H by RESCUEv3, v7, and v16 with targeting and non-targeting guides. Fluorescence is measured by performing flow cytometry on 10,000 cells. (FIG. 84B) Percent editing correction of the GFP mutation Y66H by RESCUEv3, v7, and v16 with targeting and non-targeting guides. Values represent mean+/−S.E.M (n=3). (FIG. 84C) Percent editing correction of the HIS3 mutation P196L by RESCUEv7, and v16 with targeting and non-targeting guides. Values represent mean+/−S.E.M (n=3). (FIG. 84D) Percent editing correction of the HIS3 mutation S129P by RESCUEv7, and v16 with targeting and non-targeting guides. Values represent mean+/−S.E.M (n=3).

(FIG. 85A) Adenosine deamination activity of ADAR2 deaminase domain protein containing RESCUEv2 mutations with a 22 bp double-stranded RNA substrate containing a center adenine mismatched with a cytosine. Reactions were incubated for varying time points and with and without the deaminase domain. (FIG. 85B) Cytidine deamination activity of ADAR2 deaminase domain protein containing RESCUEv2 mutations with a 22 bp double-stranded RNA substrate containing a center cytosine mismatched with a uridine. Reactions were incubated for varying time points and with and without the deaminase domain.

(FIG. 86A) Percent editing of a site in the Gluc transcript with varying 5' bases with a targeting guide and RESCUEv16, full ADAR2 (with RESCUEv16 mutations), ADAR2 deaminase domain (with RESCUEv16 mutations), and no protein. Values represent mean+/−S.E.M (n=3). (FIG. 86B) Percent editing of a site in the Gluc transcript with varying 5' bases with a non-targeting guide and RESCUEv16, full ADAR2 (with RESCUEv16 mutations), ADAR2 deaminase domain (with RESCUEv16 mutations), and no protein. Values represent mean+/−S.E.M (n=3). (FIG. 86C) Editing of a UCG site in the Glue transcript with RESCUEv16 and guide RNAs containing varying mismatch positions. Values represent mean+/−S.E.M (n=3). (FIG. 86D) Editing of a UCG site in the Gluc transcript with full-length ADAR2 (with RESCUEv16 mutations) and guide RNAs containing varying mismatch positions. Values represent mean+/−S.E.M (n=3). (FIG. 86E) Editing of a UCG site in the Gluc transcript with ADAR2 deaminase domain (with RESCUEv16 mutations) and guide RNAs containing varying mismatch positions. Values represent mean+/−S.E.M (n=3).

(FIG. 87A) Percent editing of endogenous target sites with varying base motifs with RESCUEv16 and guides with mismatches at position 7, 9, 11, and 13 and U base flips. Values represent mean+/−S.E.M (n=3). (FIG. 87B) Percent editing of endogenous target sites with varying base motifs with RESCUEv16 and guides with mismatches at position 7, 9, 11, and 13 and C base flips. Values represent mean+/−S.E.M (n=3). (FIG. 87C) Percent editing of endogenous target sites with varying base motifs with RESCUEv16 and guides with mismatches at position 3, 5, 7, 9, and 11 and C and U base flips. Values represent mean+/−S.E.M (n=3).

(FIG. 91A) Schematic of editing site of *Gaussia* luciferase mutant C82R, with the targeted C highlighted in red and nearby adenine bases numbered and highlighted in gray. (FIG. 91B) Percent editing of at nearby adenine bases in *Gaussia* luciferase mutant C82R with targeting by RESCUEv0, RESCUEv8, and RESCUEv16. (FIG. 91C) Percent editing of adenine to guanosine at adenine 20 by varying amounts of RESCUEv0-v16. Values represent mean of three replicates.

(FIG. 92A) Luciferase correction via adenosine deamination of the Gluc transcript by RESCUEv0-v16 and RESCUEv16S using a targeting guide RNA. Values represent mean+/−S.E.M (n=3). (FIG. 92B) Luciferase correction via adenosine deamination of the Gluc transcript by RESCUEv0-v16 and RESCUEv16S using a non-targeting guide RNA. Values represent mean+/−S.E.M (n=3). (FIG. 92C) Percent editing of adenosine to inosine of the Gluc transcript by RESCUEv0-v16 and RESCUEv16S using a targeting guide RNA. Values represent mean+/−S.E.M (n=3). (FIG. 92D) Percent editing of adenosine to inosine of the Gluc transcript by RESCUEv0-v16 and RESCUEv16S using a non-targeting guide RNA. Values represent mean+/−S.E.M (n=3).

(FIG. 93A) Schematic of editing site of CTNNB1 T41I, with the targeted C highlighted in red and the nearby off-target adenine base highlighted in gray. (FIG. 93B) Percent editing of cytosine to uridine (T41A) by varying amounts of RESCUEv0-v16 and RESCUEv16S. Values represent mean of three replicates. (FIG. 93C) Percent editing of adenine to guanosine at the off-target adenine by varying amounts of RESCUEv0-v16 and RESCUEv16S. Values represent mean of three replicates.

(FIG. 94A) Percent editing of endogenous target sites with varying base motifs with RESCUEv16 and RESCUEv16S. Values represent mean+/−S.E.M (n=3). (FIG. 94B) Percent editing of at neighboring adenine bases in NRAS I21I with targeting by RESCUEv16 and RESCUEv16S. (FIG. 94C) Percent editing of at neighboring adenine bases in NF2 T21M with targeting by RESCUEv16 and RESCUEv16S. (FIG. 94D) Percent editing of at neighboring adenine bases in RAF1 P30S with targeting by RESCUEv16 and RESCUEv16S. (FIG. 94E) Percent editing of at neighboring adenine bases in CTNNB1 P44S with targeting by RESCUEv16 and RESCUEv16S.

(FIG. 97A) Amino acid conversions possible using cytidine deamination by RESCUE. (FIG. 97B) Codon table showing all potential amino acid changes possible by RESCUE.

FIG. 103A. Schematic of RNA targeting of the catalytic residue mutant (C82R) of *Gaussia* luciferase reporter transcript (SEQ ID NO:712-714). FIG. 103B. Heatmap depicting the percent editing levels of RESCUEr0-r16 on cytidines flanked by varying bases on the Gluc transcript. More favorable editing motifs are shown at the top, while less favorable motifs (5'C) are shown at the bottom. FIG. 103C. Editing activity of RESCUE on all possible 16 cytidine flanking bases motifs on the Gluc transcript with U-flip or C-flip guides. FIG. 103D. Activity comparison between RESCUE, ADAR2dd without Cas13, full-length ADAR2 without Cas13, or no protein. FIG. 103E. Editing efficiency of RESCUE on a panel of endogenous genes covering multiple motifs. The best guide for each site is shown with the entire panel of guides displayed in FIG. 125.

FIG. 104B. Schematic of b-catenin activation and cell growth via RESCUE editing. FIG. 104C. Percent editing by RESCUE at relevant positions in the CTNNB1 transcript. FIG. 104D. Activation of Wnt/b-catenin signaling by RNA editing as measured by b-catenin-driven (TCF/LEF) luciferase expression. FIG. 104E. Representative microscopy images of RESCUE CTNNB1 targeting and non-targeting guides in HEK293FT cells. FIG. 104F. Quantitation of cellular growth due to activation of CTNNB1 signaling by RNA editing in HEK293FT cells.

FIG. 105A. Schematic of multiplexed C to U and A to I editing with pre-crRNA guide arrays. FIG. 105B. Simultaneous C to U and A to I editing on CTNNB1 transcripts. FIG. 105C. Schematic of rational engineering with guanine base flips to prevent off-target activity at neighboring adenosine sites (SEQ ID NO:718-719). FIG. 105D. Percent editing at on-target C and off-target A sites for *Gaussia* luciferase (left) and KRAS (right) using rational introduction of disfavored base flips.

FIG. 106A. On-target C to U editing and summary of C to U and A to I transcriptome-wide off-targets for RESCUE compared to REPAIR. FIG. 106B. Manhattan plots of RESCUE A to I (left) and C to U (right) off-targets. The on-target C to U edit is highlighted in orange. FIG. 106C. Schematic of the interactions between ADAR2dd residues and double stranded RNA substrate with residues used in a mutagenesis screen for improving specificity highlighted red (SEQ ID NO:720-721). FIG. 106D. Luciferase values for C to U activity with a targeting guide (y-axis) and A to I activity with a non-targeting guide (x-axis) shown for RESCUE and 95 RESCUE mutants. Mutants highlighted in blue have higher specificity with maintained C to U activity. RESCUE is highlighted in red. The T375G mutation that generates REPAIRv2 is shown in orange. FIG. 106E. On-target C to U editing and summary of C to U and A to I transcriptome-wide off targets of RESCUE, REPAIR, and top specificity mutants. FIG. 106F. Manhattan plot of RESCUE-S (+S375A) A to I (left) and C to U (right) off-targets. The on-target C to U edit is highlighted in orange. FIG. 106G. Representative RNA sequencing reads surrounding the on-target Gluc editing site (blue triangle) for RESCUE (top) and RESCUE-S (bottom). A to I edits are highlighted in red; C to U (T) edits are highlighted in blue; sequencing errors are highlighted in yellow (SEQ ID NO:722-767).

FIG. 107A Amino acid conversions possible using cytidine deamination by RESCUE, with corresponding post-translation modifications and biological activities. FIG. 107B. Schematic of the directed evolution approach, involving rational mutagenesis, yeast screening, and mammalian cell validation of activity. Rational mutagenesis began with targeting residues known to contact the RNA substrate, as shown in the schematic at the top, derived from the crystal structure of ADAR2dd(23). Residues targeted with saturation mutagenesis are highlighted in red. For directed evolution, a HIS3 growth reporter was used to enable positive selection of ADAR2dd mutants in yeast with C to U editing and restoration of the HIS3 gene. Top mutants from each round of yeast evolution are evaluated in mammalian cells for C to U editing activity and then the top mutant is used for the next round of yeast evolution.

FIG. 109A. Luciferase activity of a panel of various Gluc mutants shown to previously have some effect on luciferase activity (33). Values represent mean+/−S.E.M (n=3). FIG. 109B. Luciferase activity of a panel of leucine to proline Gluc mutants. Leucine to proline mutant reporters were focused on because they generate a CCN motif site for cytidine deamination (center C is deaminated). This allows for assaying the effect of all four CCN motifs on RESCUE deamination activity. Values represent mean+/−S.E.M (n=3); WT, wildtype Gluc sequence.

FIG. 111A. Dose response of RESCUEr0-r16 activity as measured by restoration of luciferase activity on a UCG site in the Gluc transcript. Values represent mean of three replicates. FIG. 111B. Dose response of RESCUEr0-r16 activity as measured by C to U editing at a UCG site in the Gluc transcript. Values represent mean of three replicates. FIG. 111C. Dose response of RESCUEr0-r16 activity as measured by restoration of luciferase activity on the T41I site in the CTNNB1 transcript. Values represent mean of three replicates.

FIG. 113A. Percent fluorescence correction of the GFP mutation Y66H by RESCUEr3, r7, and r16 with targeting and non-targeting guides. Fluorescence is measured by performing flow cytometry on 10,000 cells. T, targeting guide; NT, non-targeting guide. FIG. 113B. Percent editing correction of the GFP mutation Y66H by RESCUEr3, r7, and r16 with targeting and non-targeting guides. T, targeting guide; NT, non-targeting guide. FIG. 113C. Percent editing correction of the HIS3 mutation P196L by RESCUEr7, and r16 with targeting and non-targeting guides. T, targeting guide; NT, non-targeting guide. FIG. 113D. Percent editing correction of the HIS3 mutation S129P by RESCUEr7, and r16 with targeting and non-targeting guides. T, targeting guide; NT, non-targeting guide. FIG. 113E. Percent editing correction of the HIS3 mutation S22P by RESCUEr3, r7, and r16 with targeting guides of varying mismatch distance and non-targeting guide at different hours after RESCUE induction. NT, non-targeting guide.

FIG. 114A. Percent editing of Gluc sites with all 16 possible 5 ÅL and 3 ÅL base combinations with RESCUEr8 using guides with either U or C mismatches. Values represent mean+/−S.E.M (n=3). FIG. 114B. Percent editing of Gluc sites with all 16 possible 5 ÅL and 3 ÅL base combinations with RESCUEr8 using guides with either G or A mismatches. Values represent mean+/−S.E.M (n=3). FIG. 114C. Percent editing of Gluc sites with all 16 possible 5 ÅL and 3 ÅL base combinations with RESCUEr16 using guides with either G or A mismatches. Values represent mean+/−S.E.M (n=3).

FIG. 117A. The RESCUE mutants are shown in the ADAR2 crystal structure (blue) along with the flipped-out cytidine modeled in purple. FIG. 117B. A zoomed in crystal structure view of the mutants at the catalytic deamination site with the RNA with the flipped-out base also shown in purple.

FIG. 118A. Luciferase correction via adenosine deamination of the Gluc transcript by RESCUEr0-r16 and RESCUEr16-S using a targeting guide RNA. Values represent mean+/−S.E.M (n=3). FIG. 118B. Luciferase correction via adenosine deamination of the Gluc transcript by RESCUEr0-v16 and RESCUEr16-S using a non-targeting guide RNA. Values represent mean+/−S.E.M (n=3). FIG. 118C. Percent editing of adenosine to inosine of the Gluc transcript by RESCUEr0-r16 and RESCUEr16-S using a targeting guide RNA. Values represent mean+/−S.E.M (n=3). FIG. 118D. Percent editing of adenosine to inosine of the Gluc transcript by RESCUEr0-r16 and RESCUEr16-S using a non-targeting guide RNA. Values represent mean+/−S.E.M (n=3).

FIG. 119A. Evaluation of C to U deaminase activity of individual RESCUE mutations added on REPAIR (RESCUEr0) targeting a site on the luciferase transcript, as measured by luciferase activity restoration. Values represent mean+/−S.E.M (n=3); WT, RESCUEr0 sequence. FIG. 119B. Evaluation of C to U deaminase activity of individual RESCUE mutations added on REPAIR (RESCUEr0) targeting a site on the luciferase transcript, as measured by percent editing. Values represent mean+/−S.E.M (n=3); WT, RESCUEr0 sequence. FIG. 119C. Evaluation of C to U deaminase activity of RESCUEr16 constructs with individual mutations removed targeting a site on the luciferase transcript, as measured by luciferase activity restoration. Values represent mean+/−S.E.M (n=3); WT, RESCUEr16 sequence. FIG. 119D. Evaluation of C to U deaminase activity of RESCUEr16 constructs with individual mutations removed targeting a site on the luciferase transcript, as measured by percent editing. Values represent mean+/−S.E.M (n=3); WT, RESCUEr16 sequence.

FIG. 120A. Adenosine deamination activity of ADAR2 deaminase domain protein containing various candidate mutations with a 22 bp double-stranded RNA substrate containing a center adenine mismatched with a cytidine. Reactions were incubated for varying time points and with and without the deaminase domain. Values represent mean+/−S.E.M (n=3, some error bars occluded by symbols). FIG. 120B. Cytidine deamination activity of ADAR2 deaminase domain protein containing various candidate mutations with a 22 bp double-stranded RNA substrate containing a center cytidine mismatched with a uridine. Reactions were incubated for varying time points and with and without the deaminase domain. Values represent mean+/−S.E.M (n=3, some error bars occluded by symbols). FIG. 120C. RESCUE r0 and r16 cytidine deaminase activity on RNA and DNA substrates, including a cytidine in RNA annealed to complementary DNA (RNA:DNA), a deoxycytidine in DNA annealed to complementary RNA (DNA:RNA), a deoxycytidine in double stranded DNA (dsDNA), and a deoxycytidine in ssDNA. All double-stranded templates contain a cytidine mismatched with a thymidine. Values represent mean+/−S.E.M (n=3). FIG. 120D. RESCUE r0 and r16 adenosine deaminase activity on RNA and DNA substrates, including an adenosine in RNA annealed to complementary DNA (RNA:DNA), a deoxyadenosine in DNA annealed to complementary RNA (DNA:RNA), a deoxyadenosine in double stranded DNA (dsDNA), and a deoxyadenosine in ssDNA. All double-stranded templates contain an adenosine mismatched with a cytidine. Values represent mean+/−S.E.M (n=3).

Figure 121A:
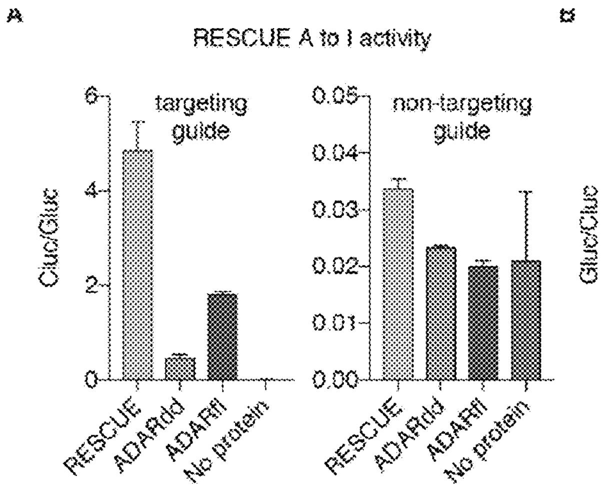
Figure 121B:
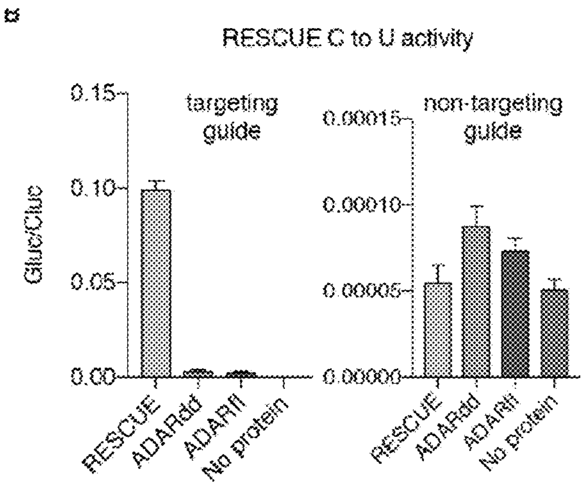
Figure 121C:
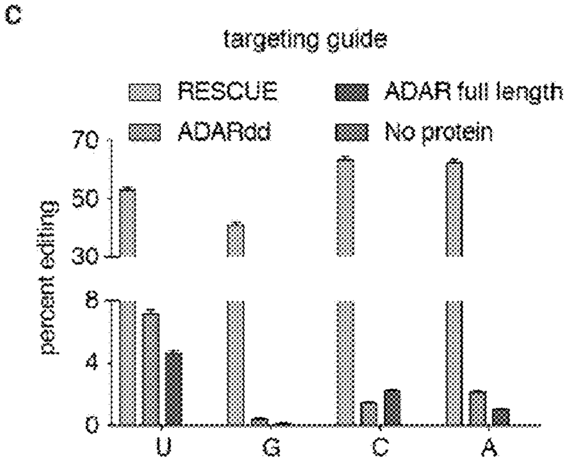
Figure 121D:
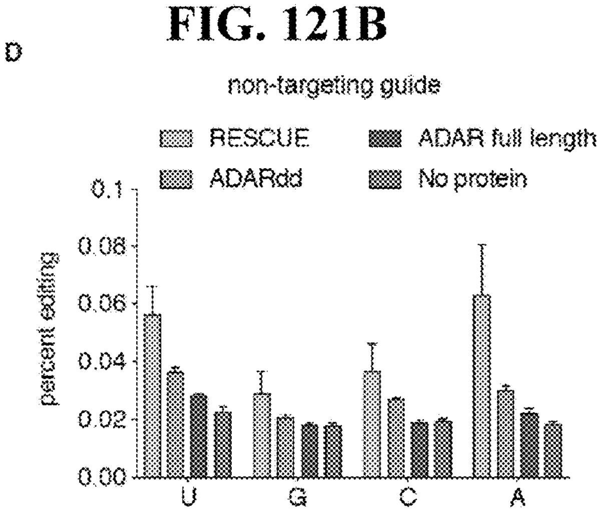

FIGS. 121A-121D Comparison of cytidine deaminase activity of RESCUEr16, full ADAR2 (with RESCUEr16 mutations), ADAR2 deaminase domain (with RESCUEr16 mutations), and without any protein. FIG. 121A. Adenosine deaminase activity measured by Cluc activity restoration with a targeting guide and RESCUEr16, full ADAR2 (with RESCUEr16 mutations), ADAR2 deaminase domain (with RESCUEr16 mutations), and no protein. Values represent mean+/−S.E.M (n=3). FIG. 121B. Cytidine deaminase activity measured by Gluc activity restoration with a targeting guide and RESCUEr16, full ADAR2 (with RESCUEr16 mutations), ADAR2 deaminase domain (with RESCUEr16 mutations), and no protein. Values represent mean+/−S.E.M (n=3). FIG. 121C. Percent editing of a site in the Gluc transcript with varying 5 ÅL bases with a targeting guide and RESCUEr16, full ADAR2 (with RESCUEr16 mutations), ADAR2 deaminase domain (with RESCUEr16 mutations), and no protein. Values represent mean+/−S.E.M (n=3). FIG. 121D. Percent editing of a site in the Gluc transcript with varying 5 ÅL bases with a non-targeting guide and RESCUEr16, full ADAR2 (with RESCUEr16 mutations), ADAR2 deaminase domain (with RESCUEr16 mutations), and no protein. Values represent mean+/−S.E.M (n=3).

Figure 122A:
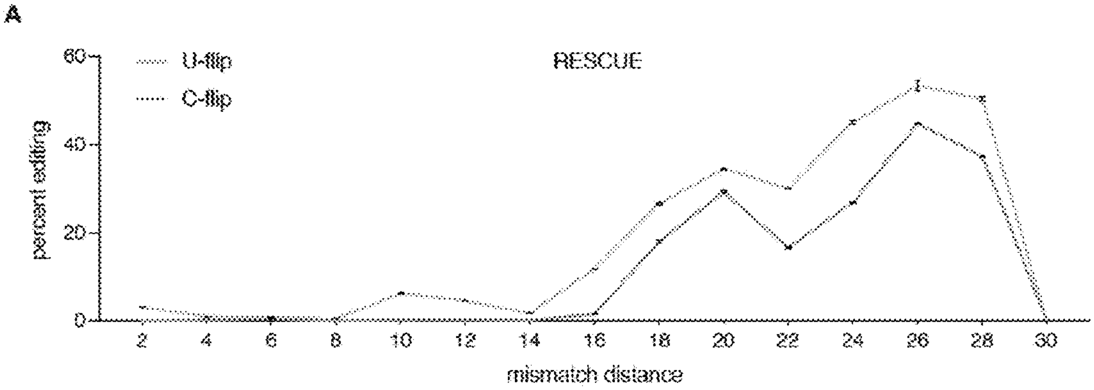
Figure 122B:
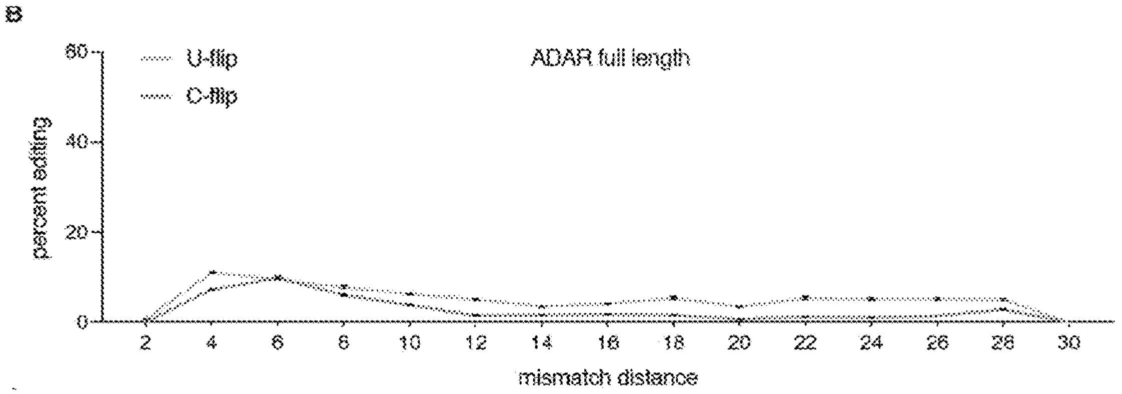
Figure 122C:
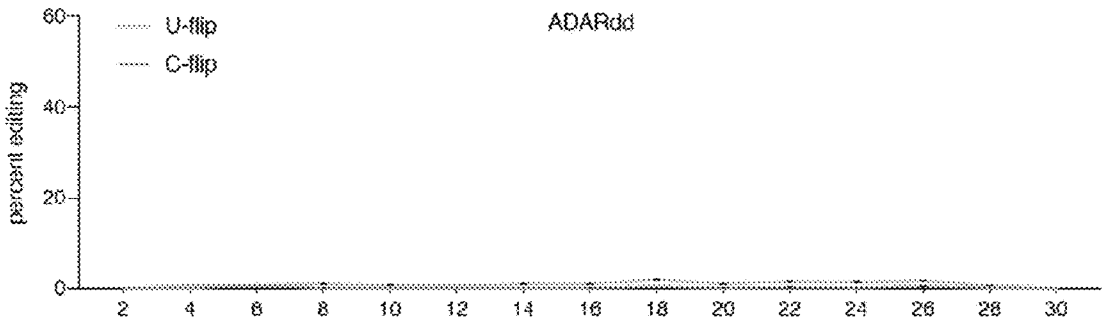

FIGS. 122A-122C Comparison of cytidine deaminase activity of RESCUEr16, full ADAR2 (with RESCUEr16 mutations), ADAR2 deaminase domain (with RESCUEr16 mutations), and without any protein. FIG. 122A. Editing of a UCG site in the Glue transcript with RESCUEr16 and guide RNAs containing varying mismatch positions. Values represent mean+/−S.E.M (n=3). FIG. 122B. Editing of a UCG site in the Gluc transcript with full-length ADAR2 (with RESCUEr16 mutations) and guide RNAs containing varying mismatch positions. Values represent mean+/−S.E.M (n=3). FIG. 122C. Editing of a UCG site in the Gluc transcript with ADAR2 deaminase domain (with RESCUEr16 mutations) and guide RNAs containing varying mismatch positions. Values represent mean+/−S.E.M (n=3).

Figure 123A:
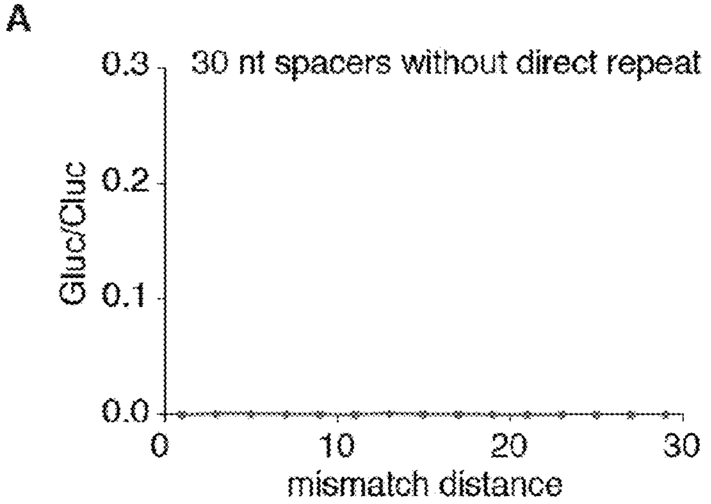
Figure 123B:
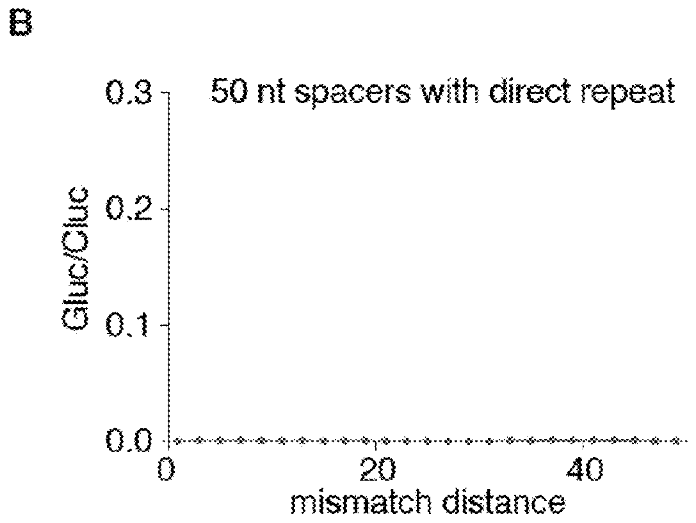
Figure 123C:
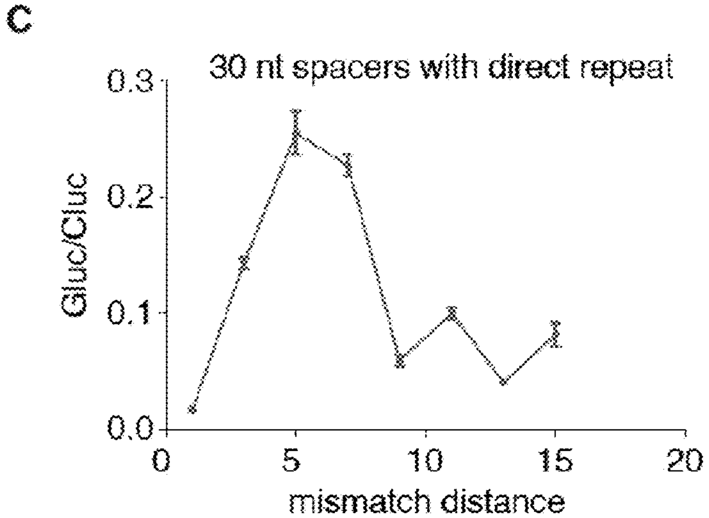

FIGS. 123A-123C Cytidine deamination activity of RESCUEr16 on a Gluc transcript with guides without direct repeats of 30 or 50 nt in length and varying mismatches. FIG. 123A. Cytidine deamination activity of RESCUEr16 on a Gluc transcript with 30 nt guides without direct repeats and varying mismatches. Values represent mean+/−S.E.M (n=3). FIG. 123B. Cytidine deamination activity of RESCUEr16 on a Gluc transcript with 50 nt guides without direct repeats and varying mismatches. Values represent mean+/−S.E.M (n=3). FIG. 123C. Cytidine deamination activity of RESCUEr16 on a Gluc transcript with 30 nt guides with direct repeats and varying mismatches. Values represent mean+/−S.E.M (n=3).

Figure 124A:
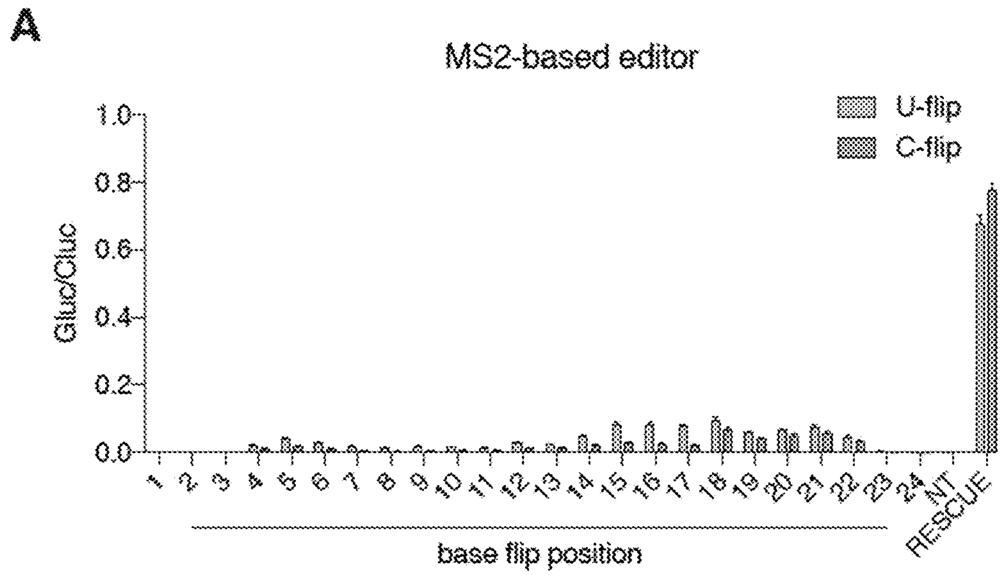
Figure 124B:
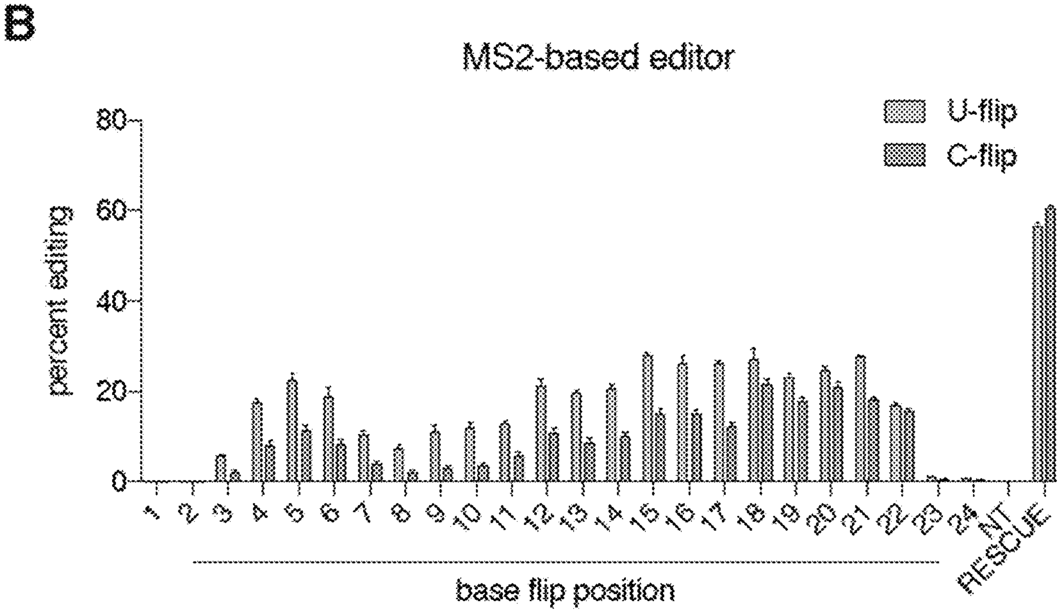
Figure 124C:
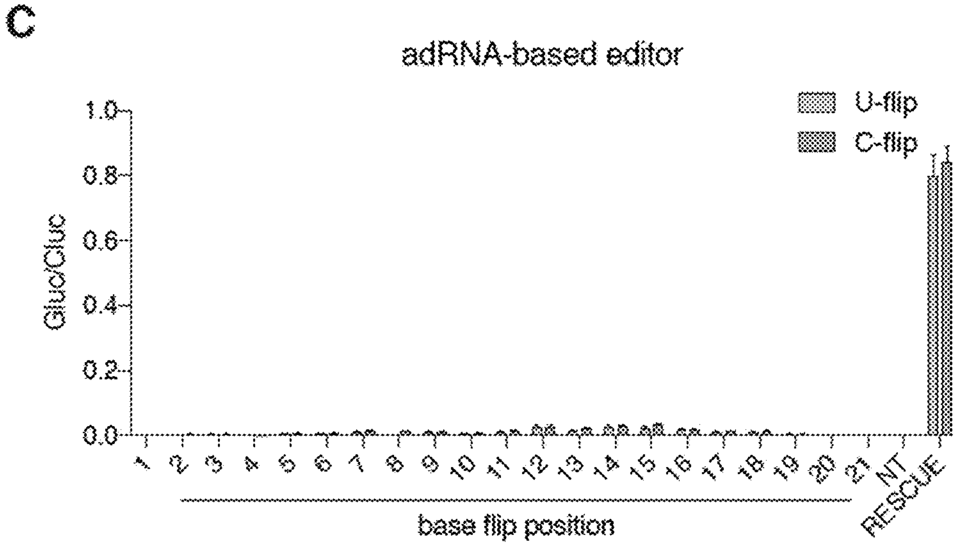
Figure 124D:
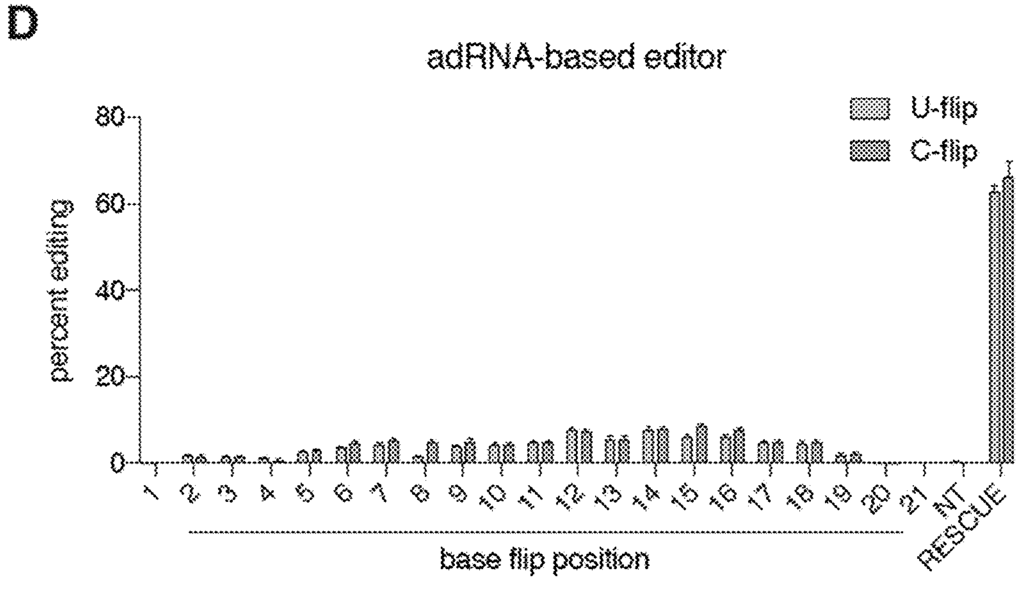
Figure 124E:
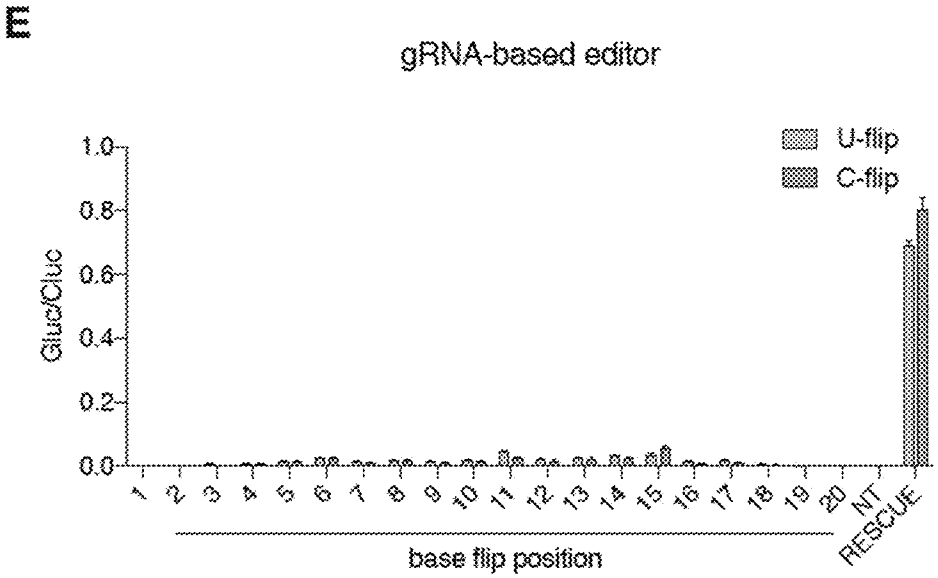
Figure 124F:

FIGS. 124A-124F Cytidine deamination activity of alternative RNA editing technologies with RESCUE mutations incorporated into them. FIG. 124 A. Cytidine deamination activity of MS2-recruited ADAR deaminase domain(24) with RESCUE mutations on a Gluc transcript with 30 nt guides with different base-flips and varying mismatches. Activity is measured by restoration of luciferase activity. Values represent mean+/−S.E.M (n=3); NT, non-targeting guide. FIG. 124B. Percent Gluc editing by MS2-recruited ADAR deaminase domain(24) with RESCUE mutations on a Gluc transcript with 30 nt guides with different base-flips and varying mismatches. Values represent mean+/−S.E.M (n=3); NT, non-targeting guide. FIG. 124C. Cytidine deamination activity of associated ADAR guide RNA technology (24) with the deaminase domain containing RESCUE mutations on a Gluc transcript with 30 nt guides with different base-flips and varying mismatches. Activity is measured by restoration of luciferase activity. Values represent mean+/−S.E.M (n=3); NT, non-targeting guide. FIG. 124D. Percent Gluc editing by associated ADAR guide RNA technology (24) with the deaminase domain containing RESCUE mutations on a Glue transcript with 30 nt guides with different base-flips and varying mismatches. Values represent mean+/−S.E.M (n=3); NT, non-targeting guide. FIG. 124E. Cytidine deamination activity of guide RNA-recruited ADAR deaminase domain(11) with RESCUE mutations on a Gluc transcript with 30 nt guides with different base-flips and varying mismatches. Activity is measured by restoration of luciferase activity. Values represent mean+/−S.E.M (n=3); NT, non-targeting guide. FIG. 124F. Percent Gluc editing by guide RNA-recruited ADAR deaminase domain (11) with RESCUE mutations on a Gluc transcript with 30 nt guides with different base-flips and varying mismatches. Values represent mean+/−S.E.M (n=3); NT, non-targeting guide.

Figure 125A:
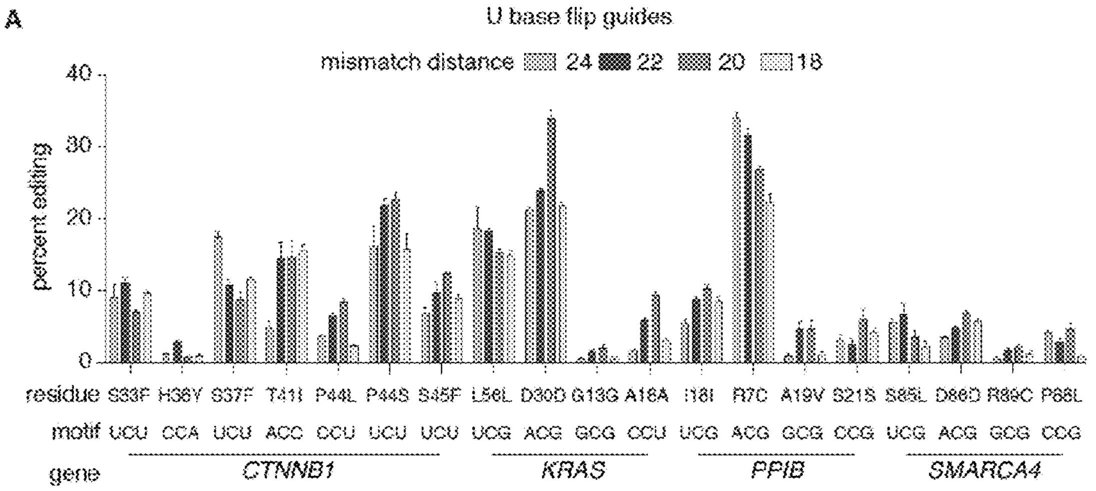
Figure 125B:
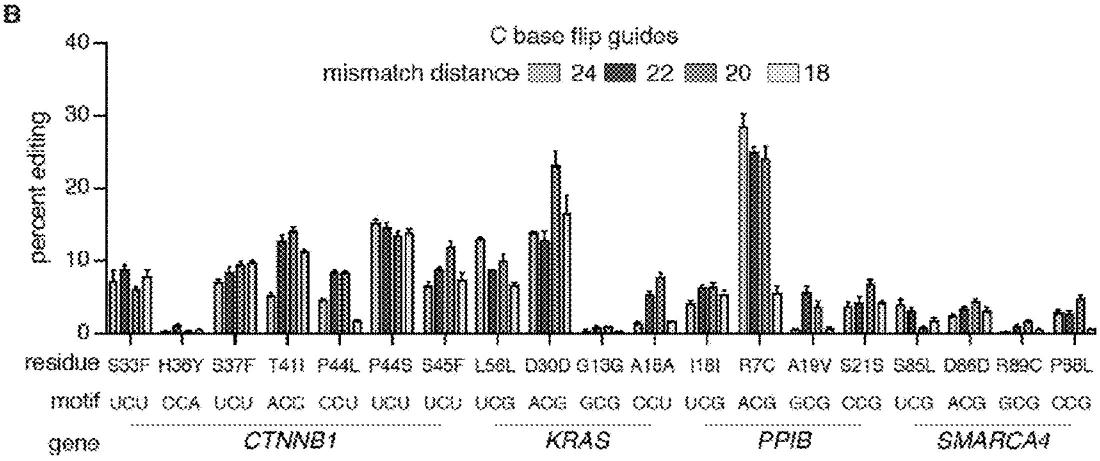
Figure 125C:
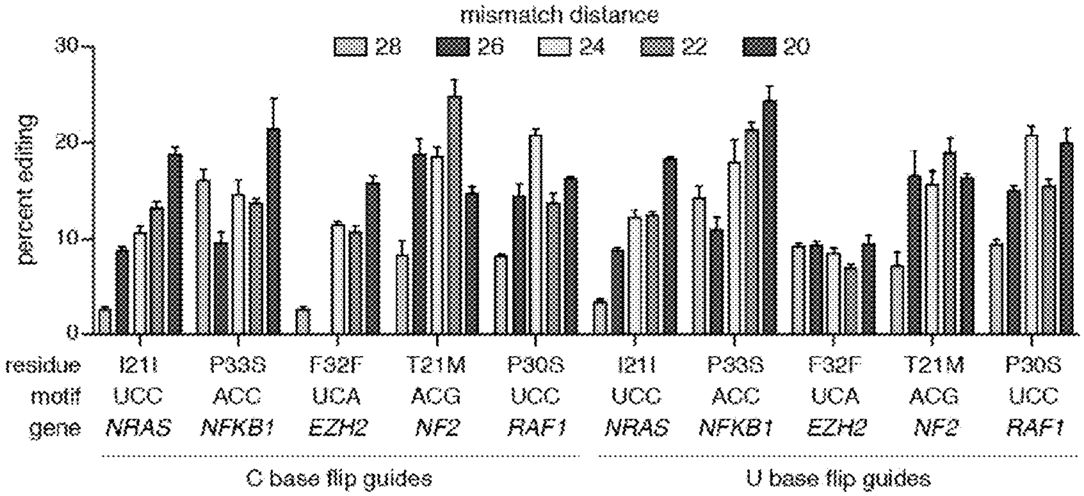

FIGS. 125A-125C Mismatch position tiling to find optimal editing guide design for RESCUE on endogenous target sites. FIG. 125A. Percent editing of endogenous target sites with varying base motifs with RESCUE and guides with mismatches at position 7, 9, 11, and 13 and U base flips. Values represent mean+/−S.E.M (n=3). FIG. 125B. Percent editing of endogenous target sites with varying base motifs with RESCUE and guides with mismatches at position 7, 9, 11, and 13 and C base flips. Values represent mean+/−S.E.M (n=3). FIG. 125C. Percent editing of endogenous target sites with varying base motifs with RESCUE and guides with mismatches at position 3, 5, 7, 9, and 11 and C and U base flips. Values represent mean+/−S.E.M (n=3).

Figure 126A:
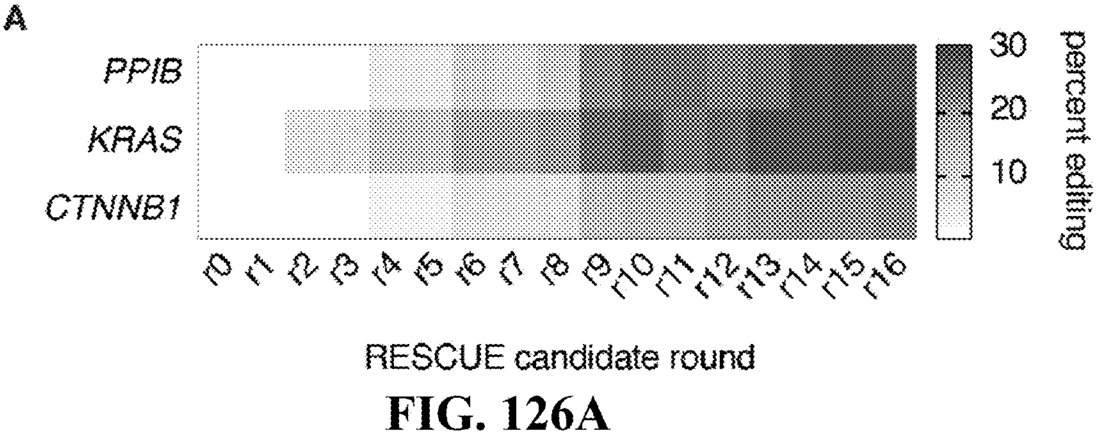
Figure 126B:
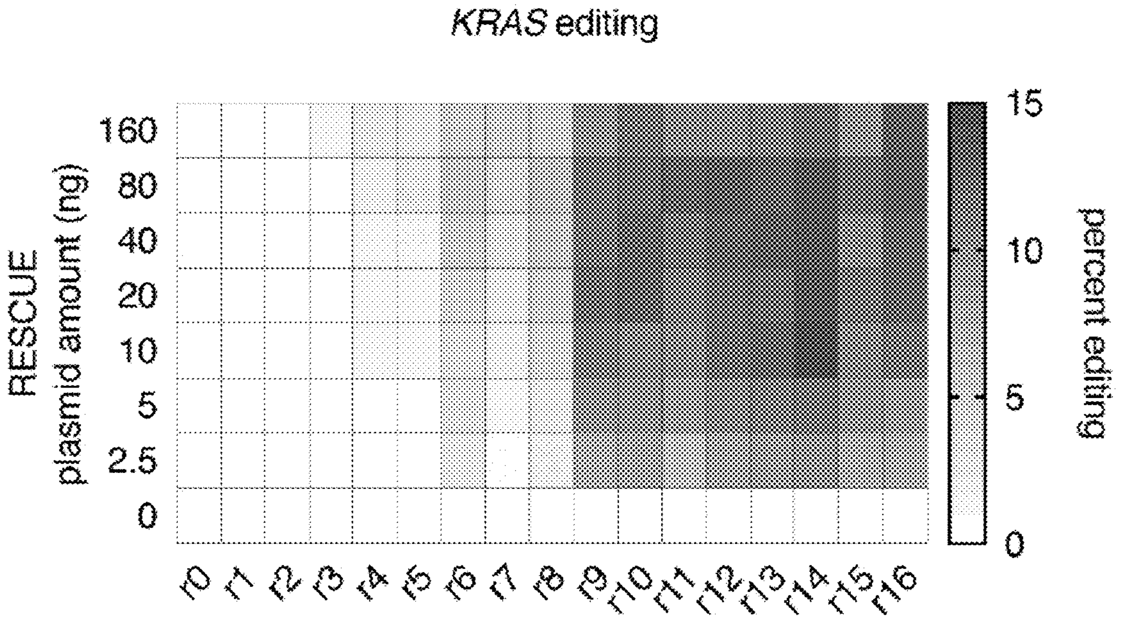

FIGS. 126A-126B Cytidine deamination activity of RESCUEr0-r16 as measured by percent editing at various endogenous sites and at varying amounts. FIG. 126A. Heatmap depicting editing efficiency of RESCUEr0-r16 on a panel of three endogenous genes. Values represent mean of three replicates. FIG. 126B. Cytidine deamination activity of varying amounts of RESCUEr0-r16 as measured by percent editing at a KRAS site. Values represent mean of three replicates.

Figure 127A:
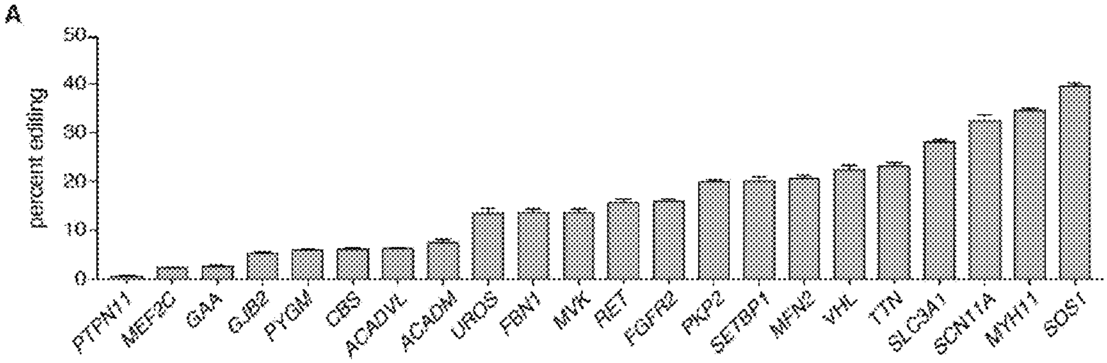
Figure 127B:
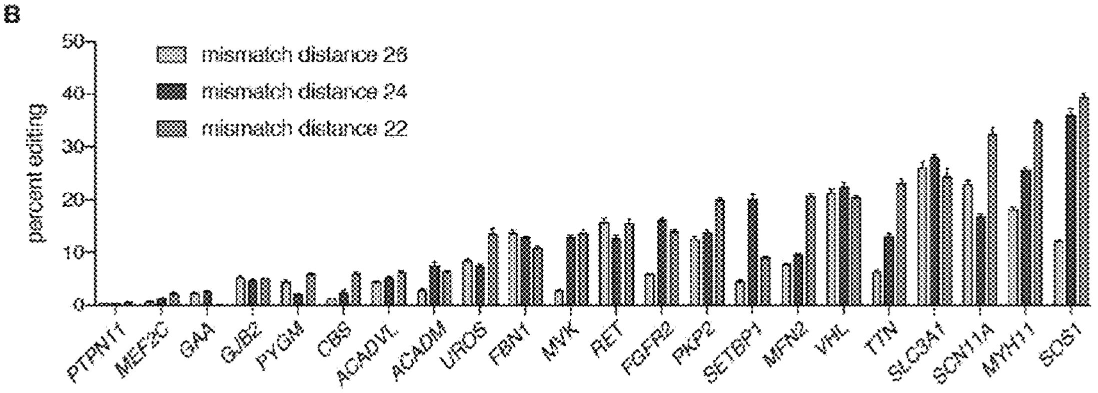

FIGS. 127A-127B Percent editing of various disease-relevant mutations on synthetic reporters. FIG. 127A. Editing efficiency of RESCUE on a set of synthetic versions of relevant T>C disease mutations with the best possible mismatch guide per target site. Editing rates vary between 1% and 42% and conditions are shown sorted by editing efficiency. All editing rates for synthetic sites are listed in Table 31. Values represent mean+/−S.E.M (n=3). FIG. 127B. Editing of disease relevant mutations using RESCUE and guides with varying mismatch positions. Values represent mean+/−S.E.M (n=3).

Figure 128:
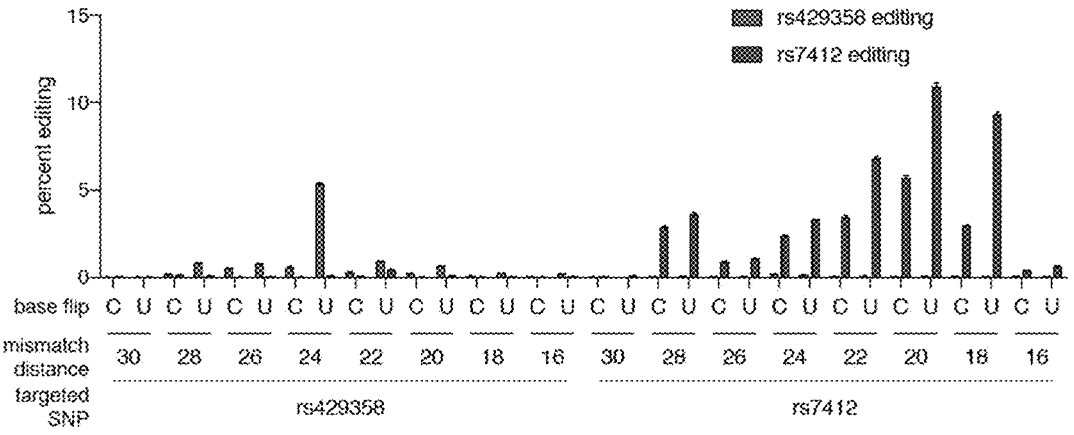

FIG. 128 Percent editing at ApoE4 cytosines with RESCUE with guides of varying C and U mismatch positions. ApoE4 variants (rs429358 and rs7412) increase Alzheimer's risk markedly, and are edited by RESCUE at rate up to 5% and 12% on the two sites. All editing rates for synthetic sites are listed in Table 31. Values represent mean+/−S.E.M (n=3).

Figure 129A:
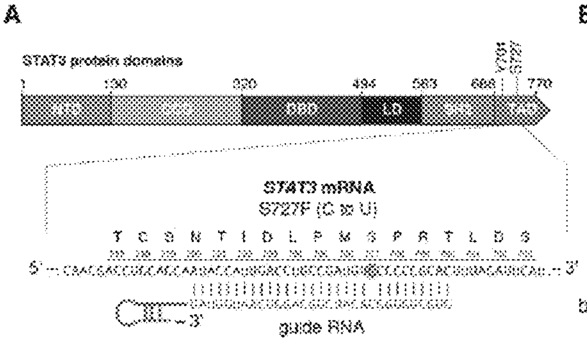
Figure 129B:
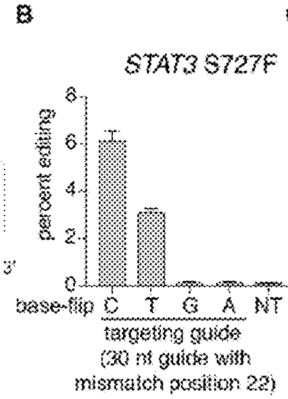
Figure 129C:
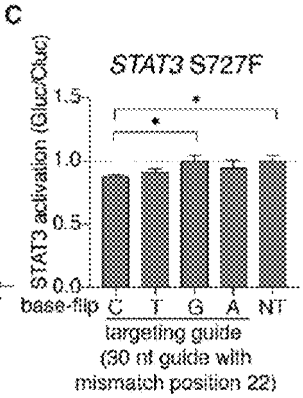
Figure 129D:
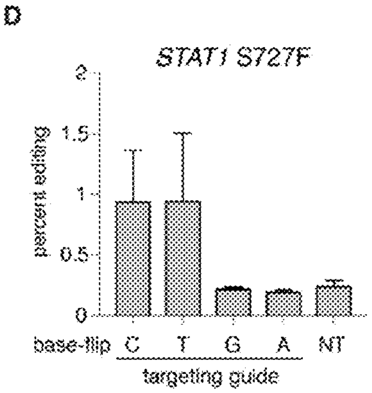
Figure 129E:
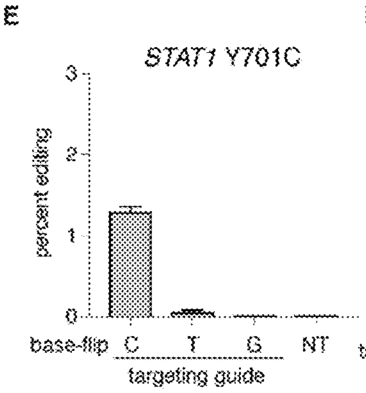
Figure 129F:
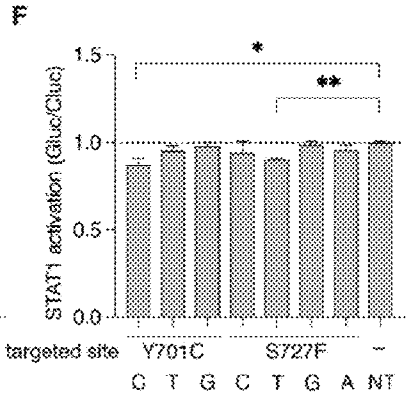

FIGS. 129A-129F RNA editing and signal modulation of STAT1/STAT3 by RESCUE. STAT3 and STAT1 are transcription factors that play important roles in signal transduction via the JAK/STAT pathway and are typically activated via phosphorylation by cytokines and growth factors. To demonstrate signaling modulation via RNA editing, we altered activation of the STAT pathway by editing phosphorylation sites Y705 and S727 on STAT3 and Y701 and S727 on STAT1 with RESCUE over the course of 48 hours. FIG. 129A. Schematic of STAT3 domains and RESCUE guides targeting phosphorylated residues of STAT3 to alter associated signaling pathways (SEQ ID NO:768-770). FIG. 129B. Percent editing at relevant phosphorylated residues in STAT3 by RESCUE. In HEK293FT cells, we observed 6% editing of the S727 STAT3 site and 11% and 7% editing of the Y701 and S727 STAT1 sites, respectively. FIG. 129C. Inhibition of STAT3 signaling by RNA editing as measured by STAT3-driven luciferase expression with guides with different base-flips. These edits resulted in 13% repression of STAT3 and STAT1 activity. FIG. 129D. Percent editing at S727F phosphorylated residue site in STAT1 by RESCUE with guides with varying base-flips. FIG. 129E. Percent editing at Y701C phosphorylated residue site in STAT1 by RESCUE with guides with varying base-flips. FIG. 129F. Inhibition of STAT1 signaling by RNA editing with RESCUE as measured by STATdriven luciferase expression.

Figure 130A:
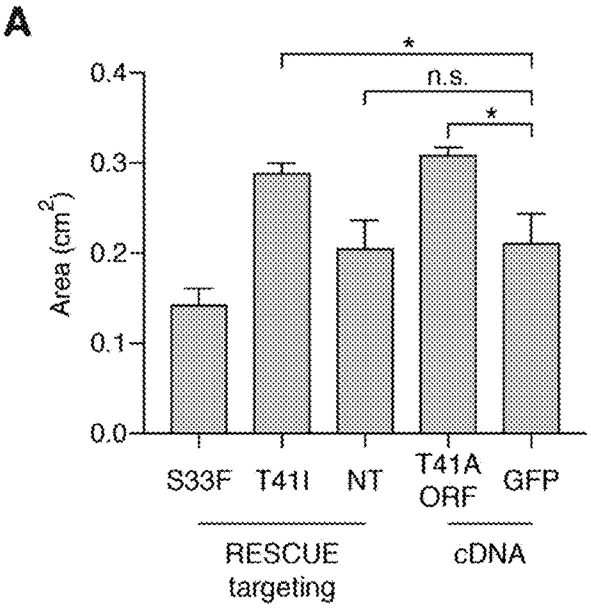
Figure 130B:
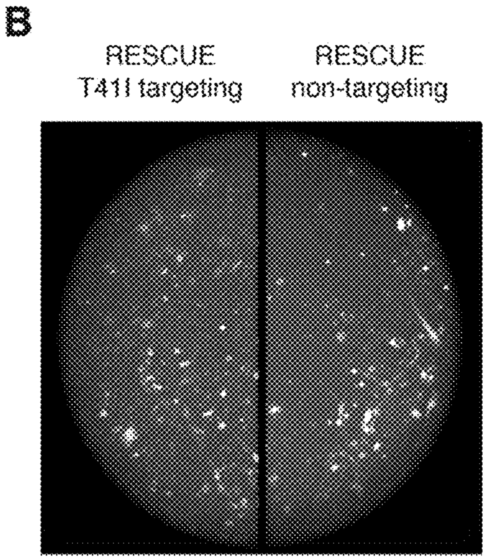

FIGS. 130A-130B Modulation of b-catenin phosphorylation and cell growth in HUVEC cells. FIG. 130A. Quantitation of cellular growth due to activation of CTNNB1 signaling by RNA editing in HUVEC cells. RESCUE stimulated HUVEC growth to levels comparable to levels observed in cells overexpressing a b-catenin phosphorylation-null mutant. NT, nontargeting guide. FIG. 130B. Representative microscopy images of RESCUE CTNNB1 targeting and non-targeting guides in HUVEC cells.

Figure 131A:
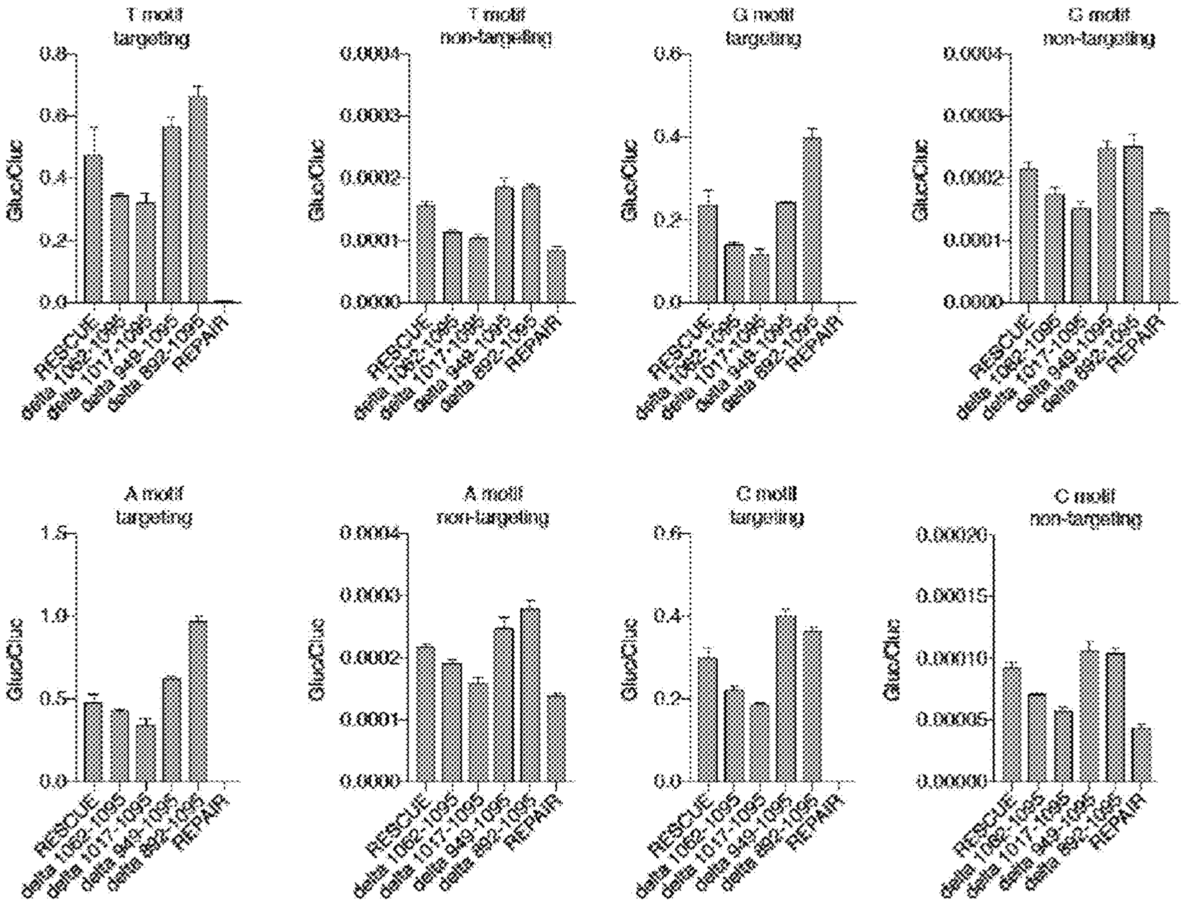
Figure 131B:
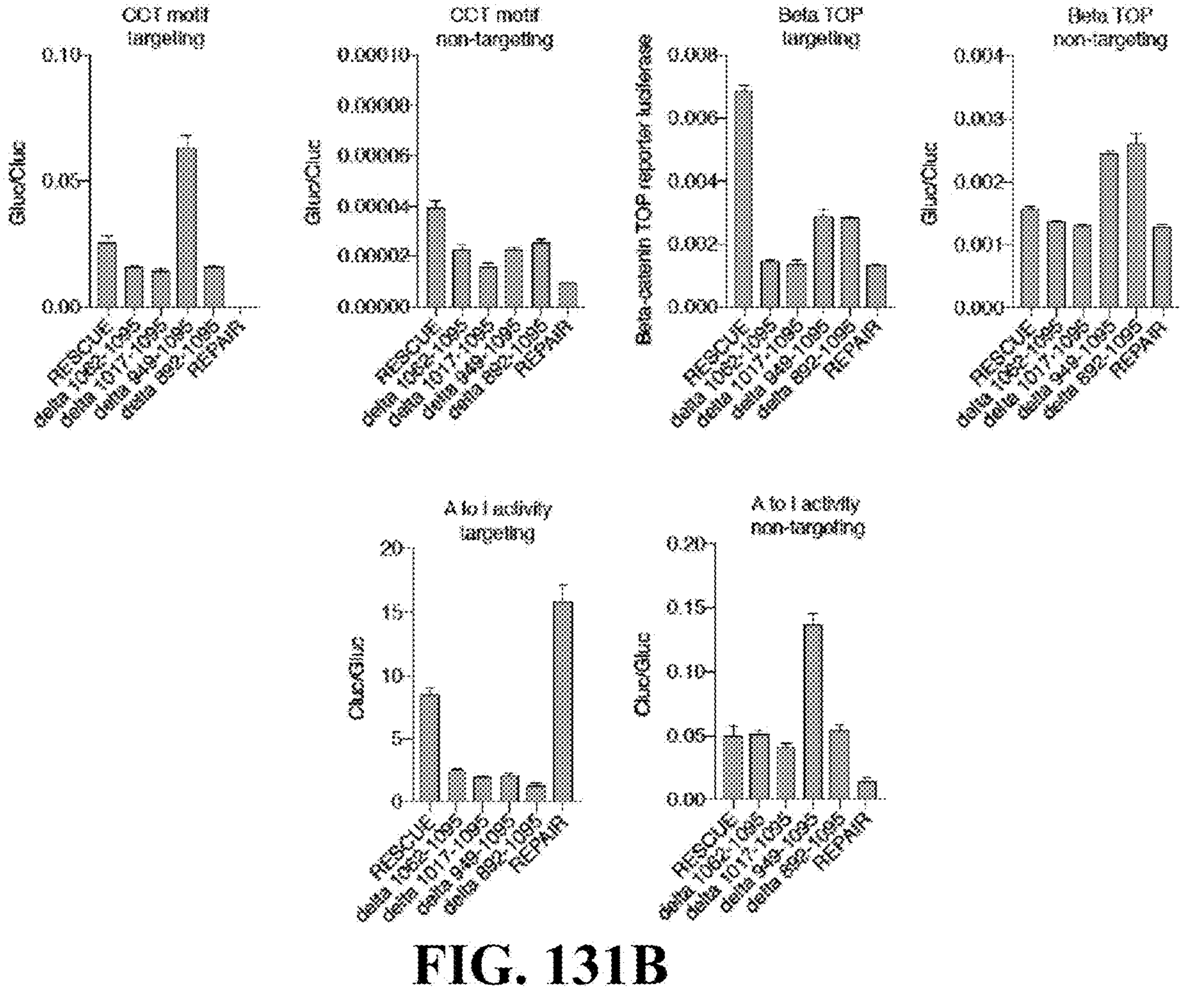

FIG. 131. RESCUE C to U and A to I activity on transcripts with varying 5' and 3' flanking bases around the target site with different C-terminal truncations of dRanCas13b.

Figure 132A:
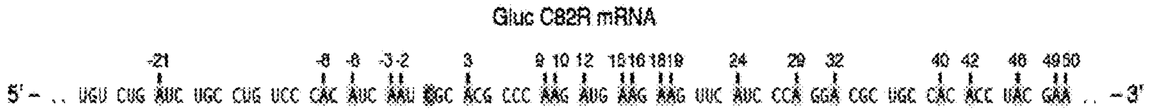
Figure 132B:
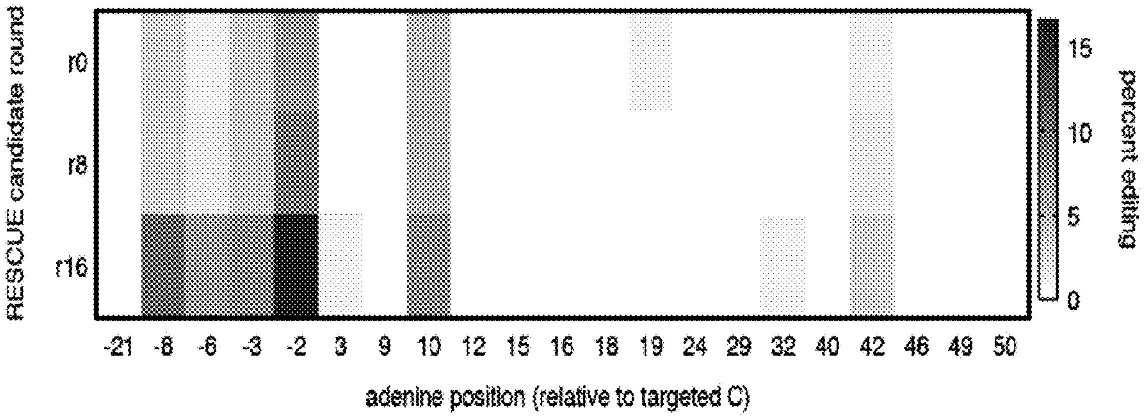
Figure 132C:
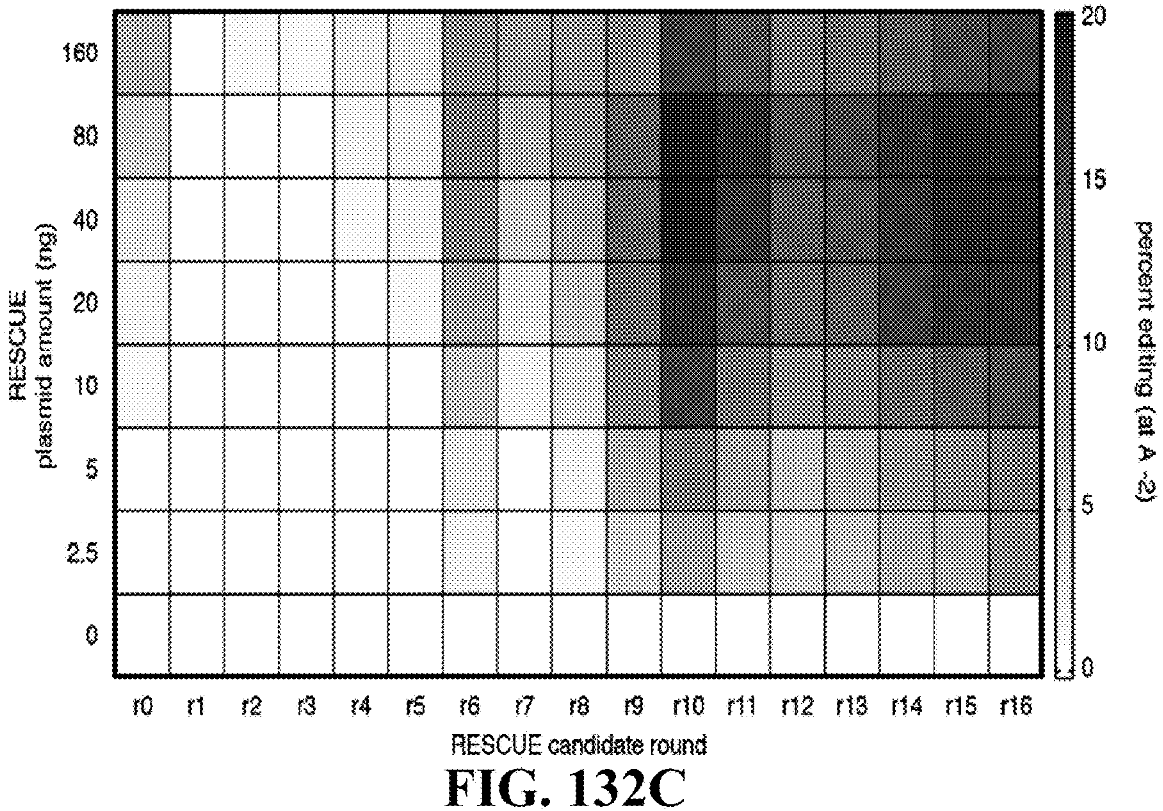

FIGS. 132A-132C Specificity of candidate rounds in the guide duplex window. FIG. 132A. Schematic of editing site of *Gaussia* luciferase mutant C82R, with the targeted C highlighted in red and nearby adenine bases numbered and highlighted in gray (SEQ ID NO:771). FIG. 132B. Percent editing of at nearby adenine bases in *Gaussia* luciferase mutant C82R with targeting by RESCUEr0, RESCUEr8, and RESCUEr16. FIG. 132C. Percent editing of adenine to guanosine at adenine 20 by varying amounts of RESCUEr0-r16. Values represent mean of three replicates.

Figure 133A:
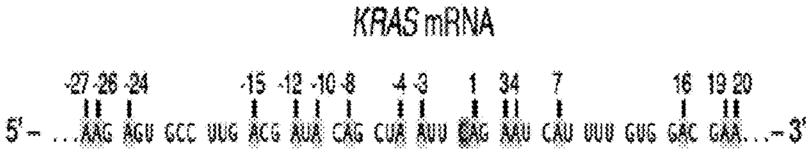
Figure 133B:
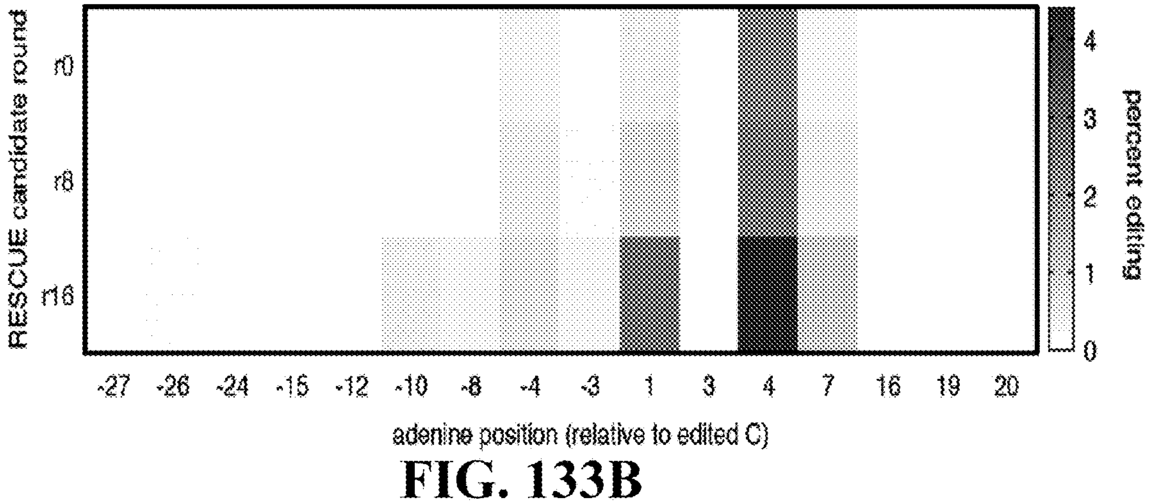
Figure 133C:
Figure 133D:
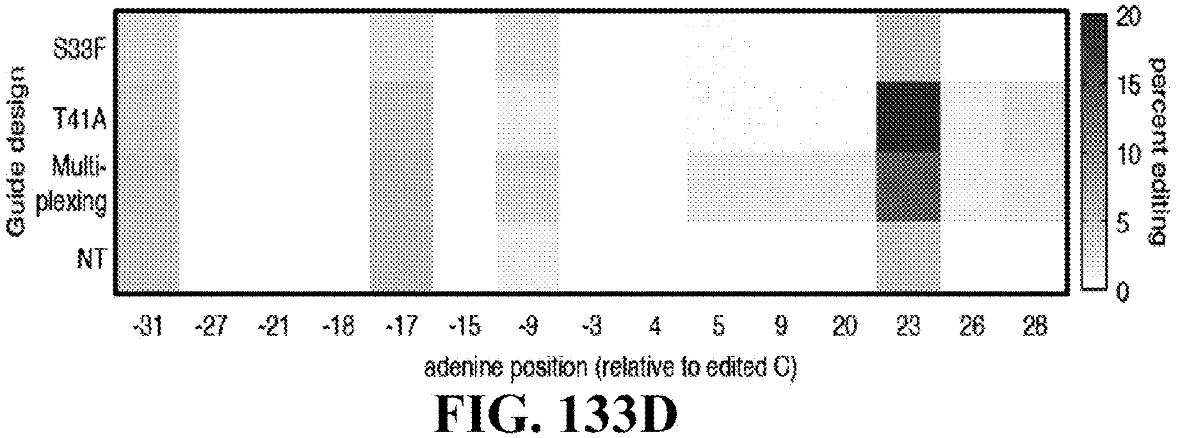

FIGS. 133A-133D Off-targets nearby target cytidines in single-plex and multiplex targeting by RESCUE r0, r8, and r16. FIG. 133A. Schematic of editing site of KRAS transcript, with the targeted C highlighted in red and nearby adenine bases numbered and highlighted in gray (SEQ ID NO:772). FIG. 133B. Percent editing of at nearby adenine bases in KRAS transcript with targeting by RESCUEr0, RESCUEr8, and RESCUEr16. FIG. 133C. Schematic of multiplexed editing sites of CTNNB1 transcript, with the two targeted C sites highlighted in red and nearby adenine bases numbered and highlighted in gray (SEQ ID NO:773). FIG. 133D. Percent editing of at nearby adenine bases in CTNNB1 transcript with multiplexed targeting by RESCUEr0, RESCUEr8, and RESCUEr16

Figure 134A:
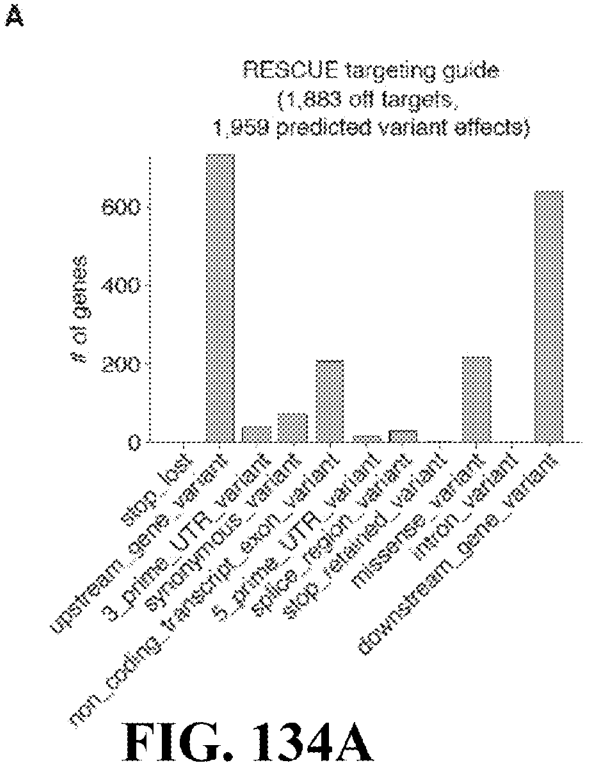
Figure 134B:
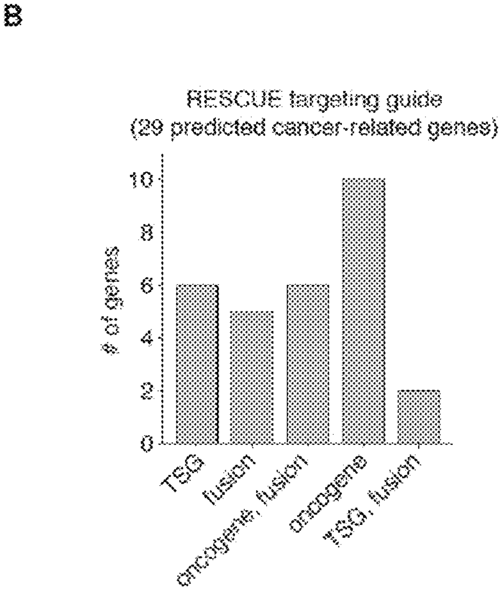
Figure 134C:
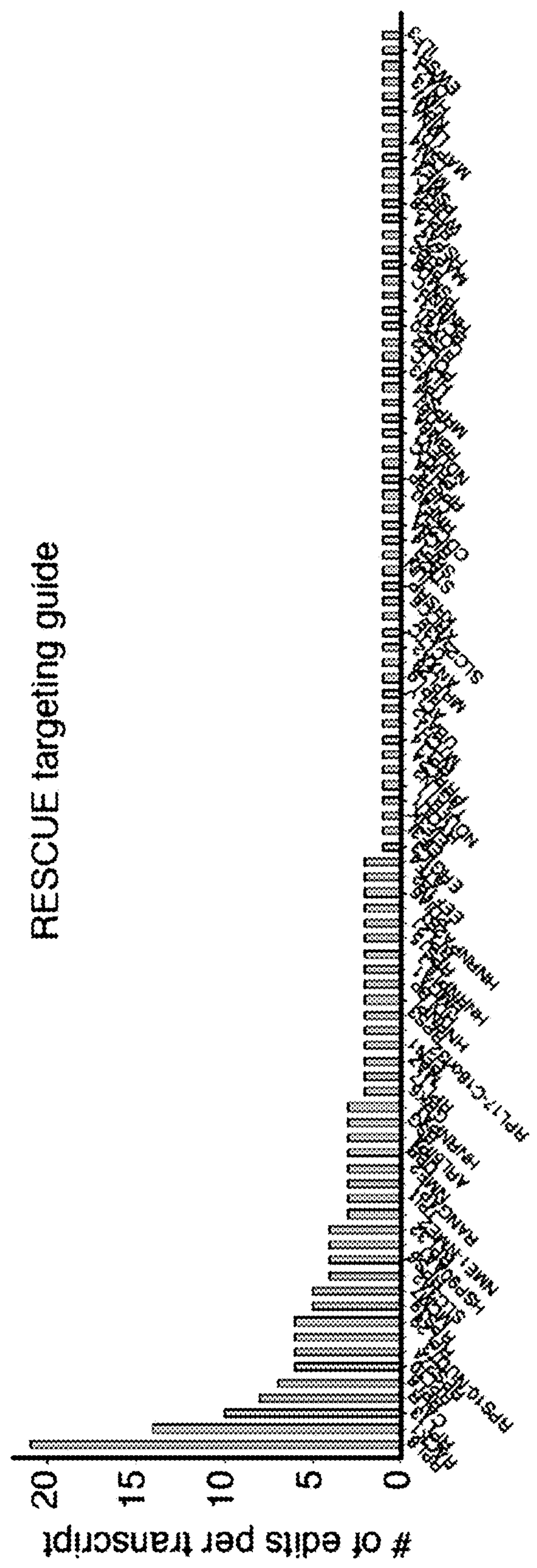
Figure 134D:
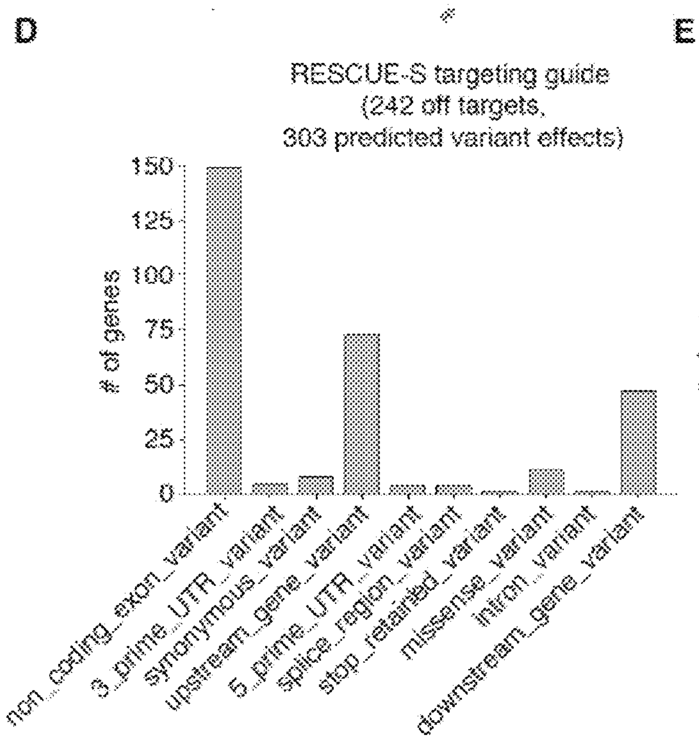
Figure 134E:
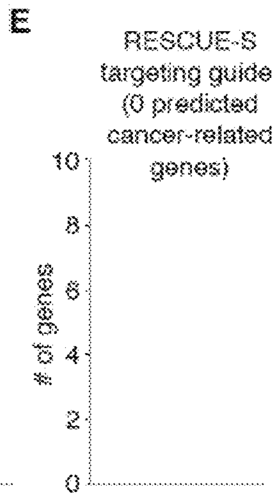
Figure 134F:
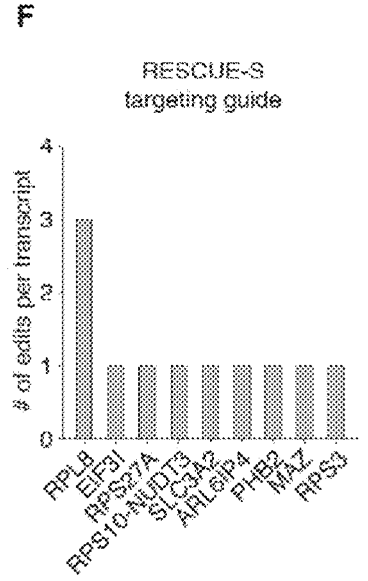

FIGS. 134A-134F Characterization of RESCUE and RESCUE-S transcriptome-wide off-targets. FIG. 134A. Predicted effect of transcriptome-wide off-target edits by RESCUE with a targeting guide against a site on the luciferase transcript. FIG. 134B. Predicted oncogenic effects of transcriptome-wide off-target edits by RESCUE with a targeting guide against a site on the luciferase transcript. FIG. 134C. Transcriptome wide off-targets visualized as the number of off-target edits per transcript by RESCUE with a targeting guide against a site on the luciferase transcript. FIG. 134D. Predicted effect of transcriptome-wide off-target edits by RESCUE-S with a targeting guide against a site on the luciferase transcript. FIG. 134E. Predicted oncogenic effects of transcriptome-wide off-target edits by RESCUE-S with a targeting guide against a site on the luciferase transcript. FIG. 134F. Transcriptome wide off-targets visualized as the number of off-target edits per transcript by RESCUE-S with a targeting guide against a site on the luciferase transcript.

Figure 135A:
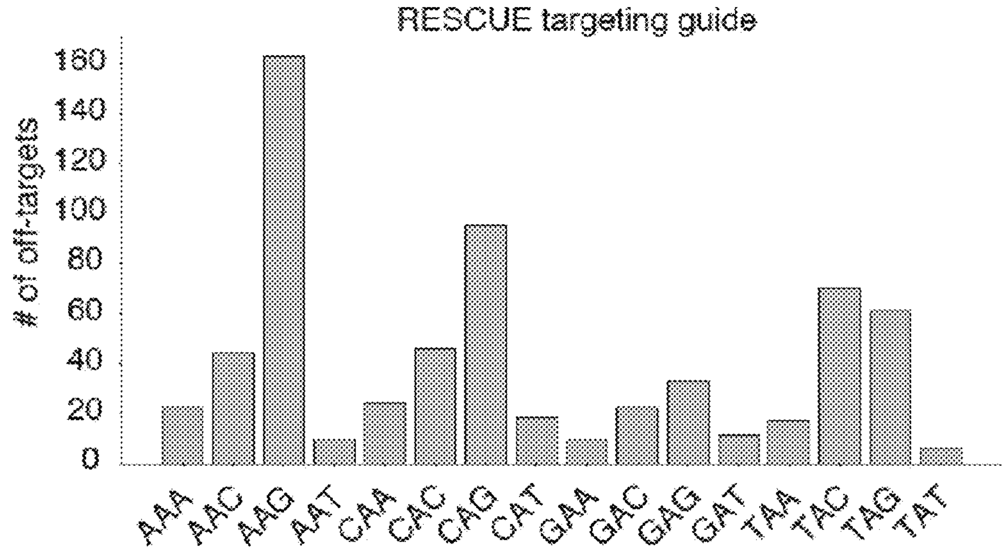
Figure 135B:
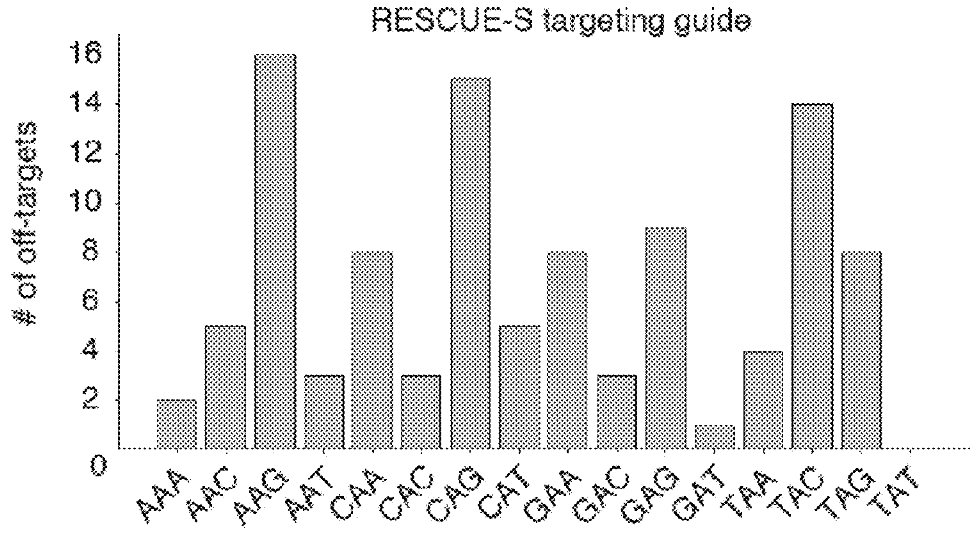
Figure 135C:
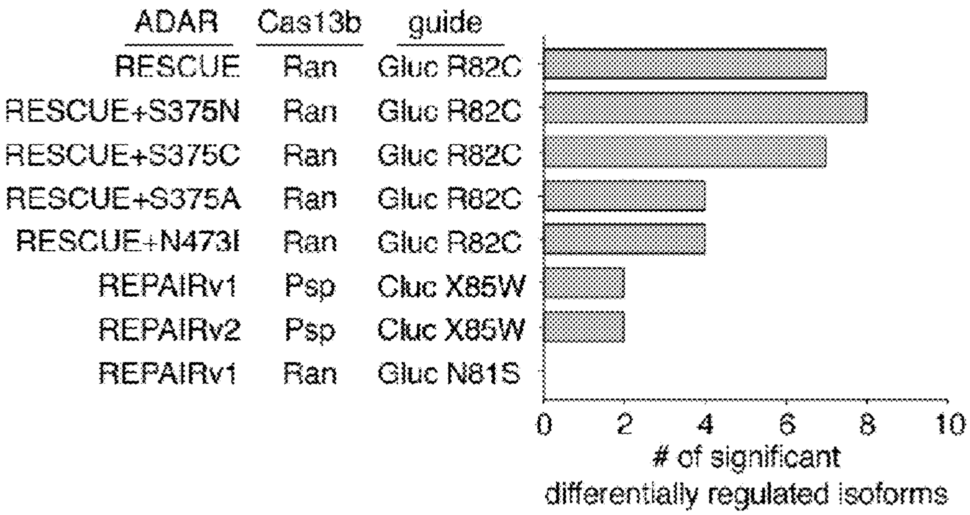

FIGS. 135A-135C Characterization of 5' and 3' flanking bases of transcriptome-wide off-targets. FIG. 135A. The number of off-targets with each of all 16 possible 5 ÅL and 3 ÅL flanking bases by RESCUE with a targeting guide against a site on the luciferase transcript. FIG. 135B. The number of off-targets with each of all 16 possible 5 ÅL and 3 ÅL flanking bases by RESCUE-S with a targeting guide against a site on the luciferase transcript. FIG. 135C. Number of significantly differentially expressed transcripts in conditions with RESCUE constructs targeting luciferase transcripts.

Figure 136A:
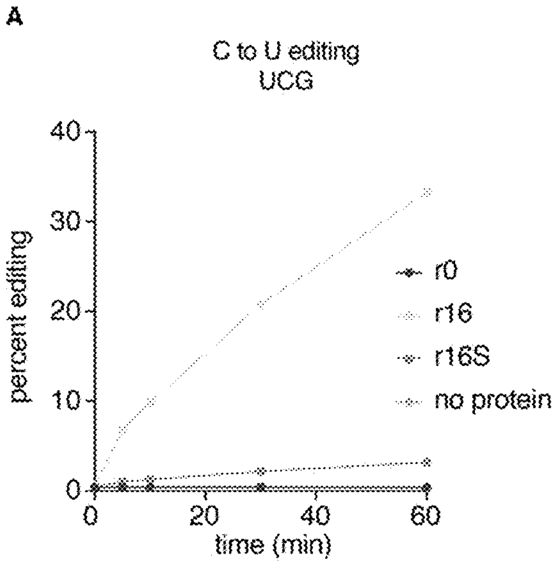
Figure 136B:
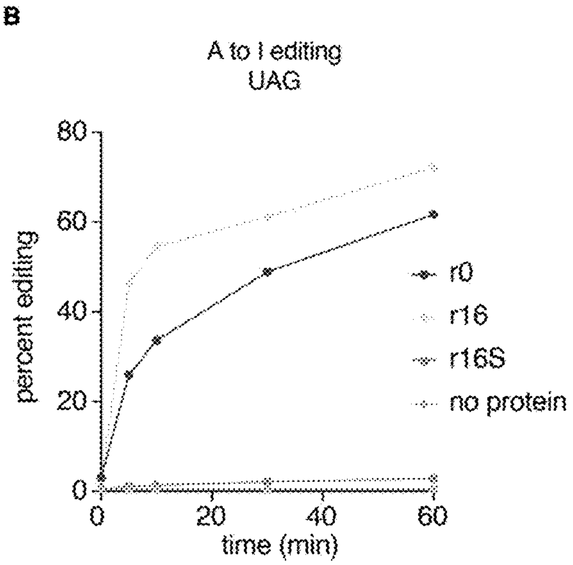

FIGS. 136A-136B Biochemical deamination activity of ADAR2 deaminase domain containing RESCUEr0, RESCUEr16 and RESCUEr16-S mutations using recombinant protein. FIG. 136A. Adenosine deamination activity of ADAR2 deaminase domain protein containing various candidate mutations with a 22 bp double-stranded RNA substrate containing a center adenine mismatched with a cytosine. Reactions were incubated for varying time points and with and without the deaminase domain. Values represent mean+/−S.E.M (n=3, some error bars occluded by symbols). FIG. 136B. Cytidine deamination activity of ADAR2 deaminase domain protein containing various candidate mutations with a 22 bp double-stranded RNA substrate containing a center cytosine mismatched with a uridine. Reactions were incubated for varying time points and with and without the deaminase domain. Values represent mean+/−S.E.M (n=3, some error bars occluded by symbols).

Figure 137A:
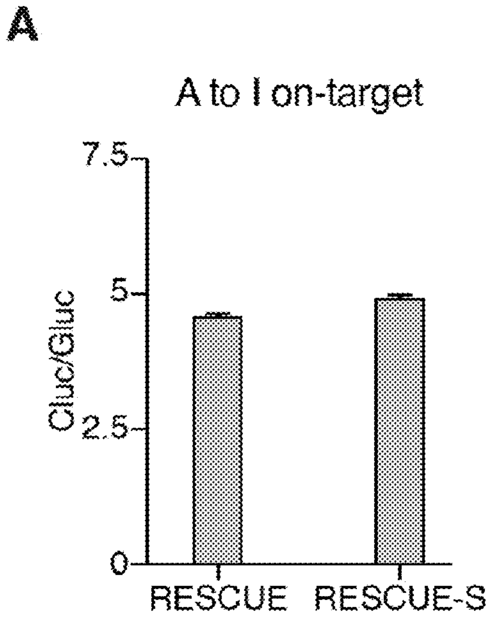
Figure 137B:
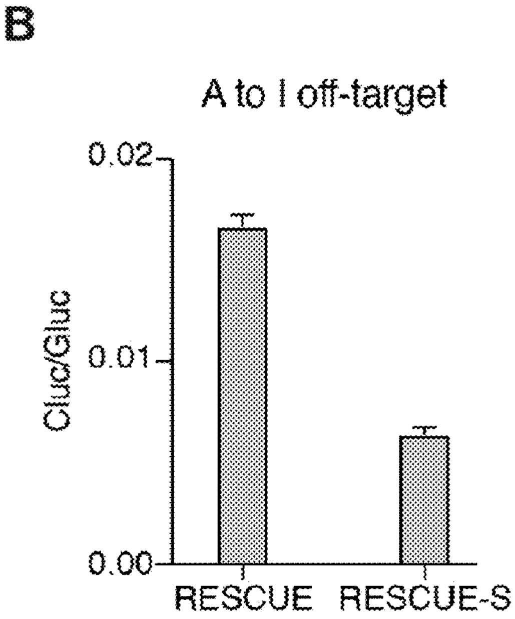
Figure 137C:
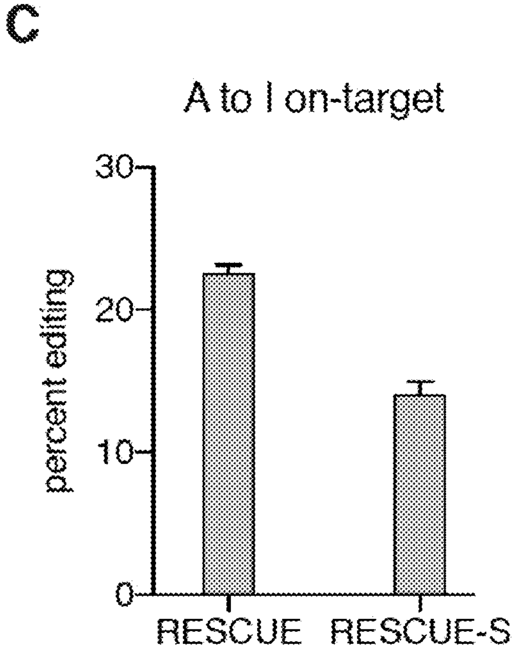
Figure 137D:
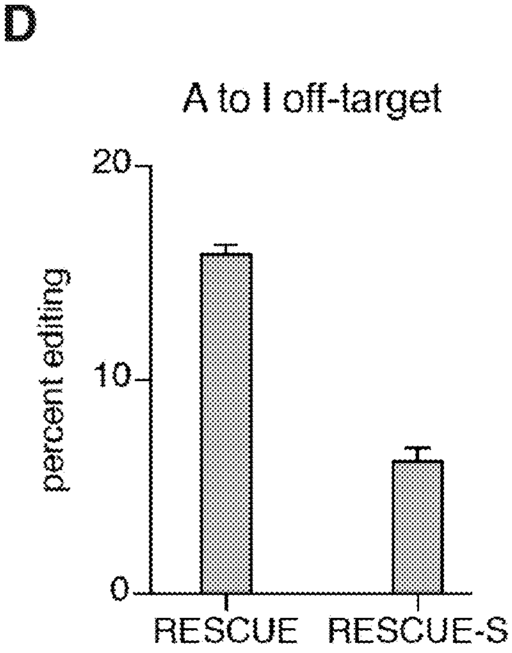

FIGS. 137A-137D Adenosine deaminase activity of RESCUE and RESCUE-S. FIG. 137A. Luciferase correction via adenosine deamination of the Gluc transcript by RESCUE and RESCUE-S using a targeting guide RNA. Values represent mean+/−S.E.M (n=3). FIG. 137B. Luciferase correction via adenosine deamination of the Gluc transcript by RESCUE and RESCUE-S using a non-targeting guide RNA. Values represent mean+/−S.E.M (n=3). FIG. 137C. Percent editing of adenosine to inosine of the Gluc transcript by RESCUE and RESCUES using a targeting guide RNA. Values represent mean+/−S.E.M (n=3). FIG. 137D. Percent editing of adenosine to inosine of the Gluc transcript by RESCUE and RESCUES using a non-targeting guide RNA. Values represent mean+/−S.E.M (n=3).

Figure 138A:
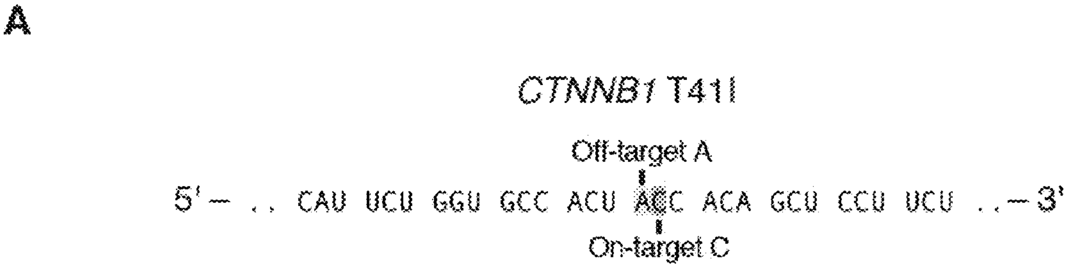
Figure 138B:
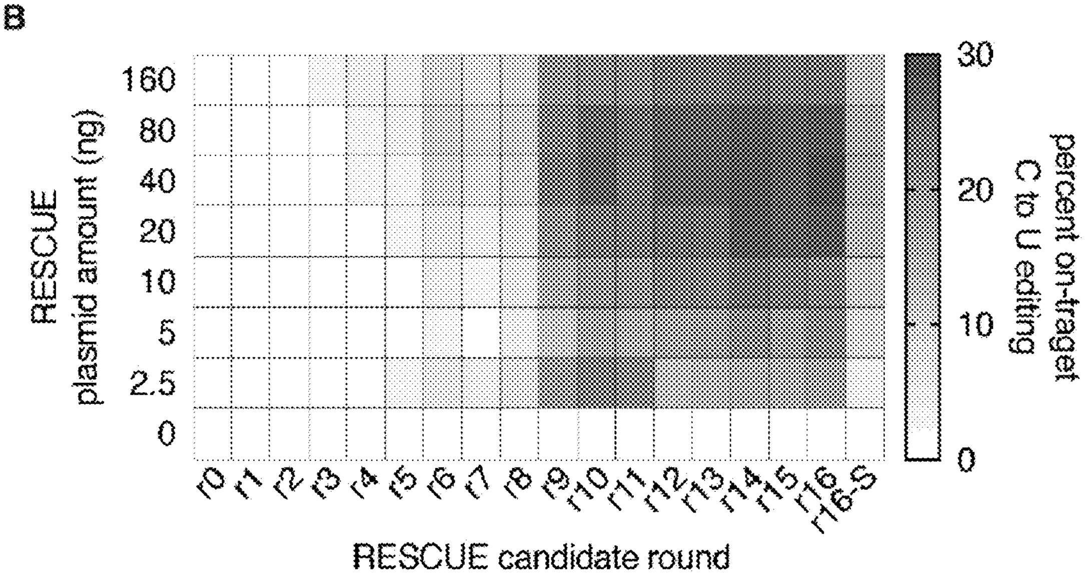
Figure 138C:
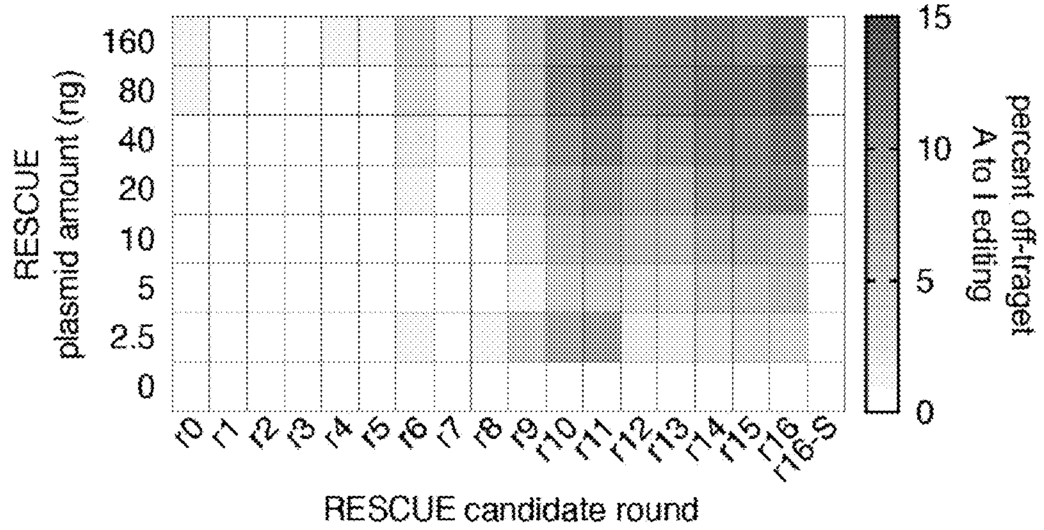

FIGS. 138A-138C Cytidine deamination activity and off-target activity on a b-catenin target site using varying amounts of RESCUEr0-r16 and RESCUEr16-S. FIG. 138A. Schematic of editing site of CTNNB1 T41I, with the targeted C highlighted in red and the nearby off-target adenine bases highlighted in gray (SEQ ID NO:774). FIG. 138B. Percent editing of cytosine to uridine (T41A) by varying amounts of RESCUEr0-r16 and RESCUEr16-S. Values represent mean of three replicates. FIG. 138C. Percent editing of adenine to guanosine at the off-target adenine by varying amounts of RESCUEr0-r16 and RESCUEr16-S. Values represent mean of three replicates.

Figure 139A:
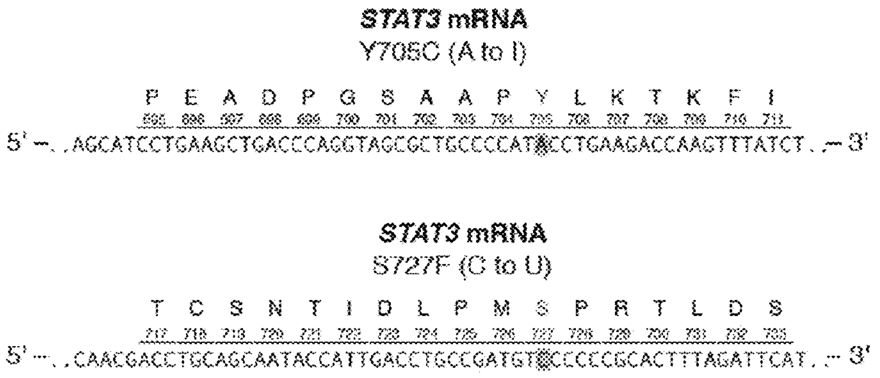
Figure 139B:
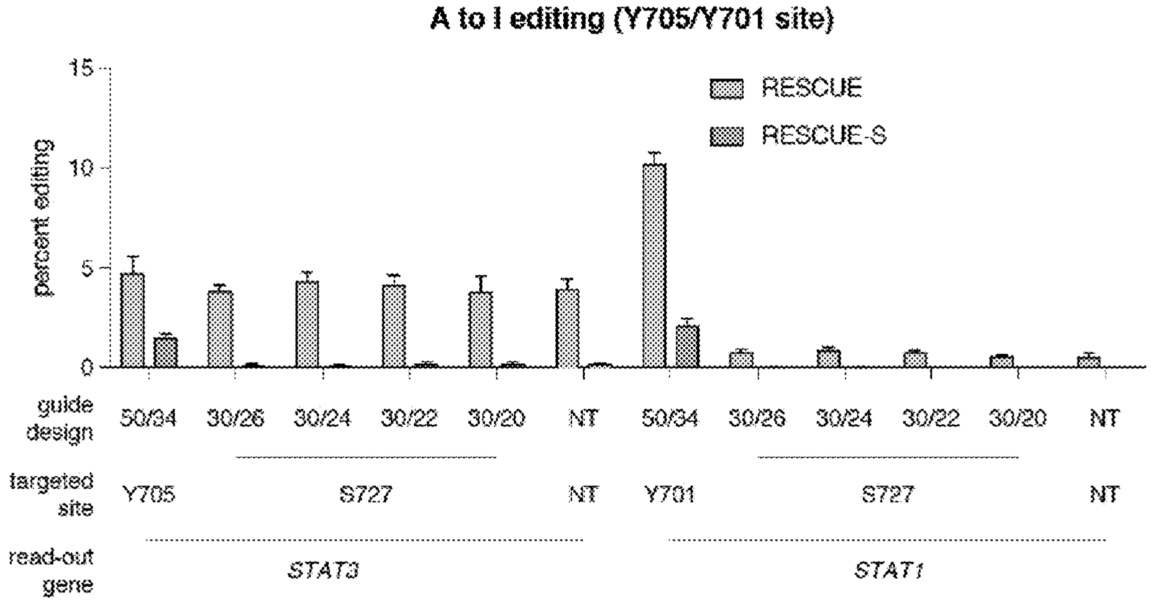
Figure 139C:
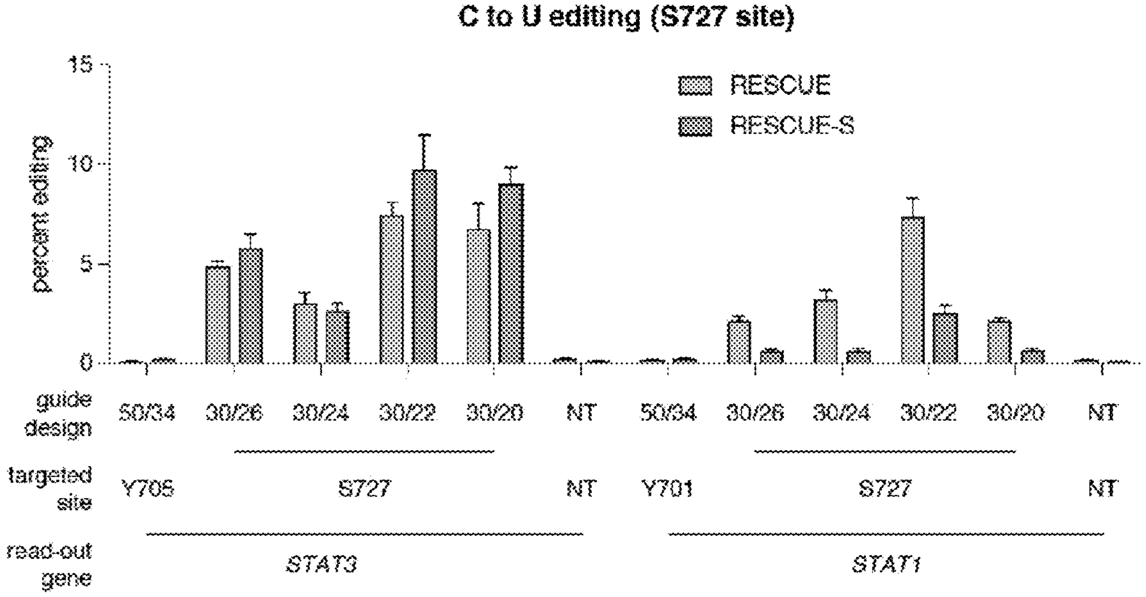

FIGS. 139A-139C Editing of STAT1 and STAT3 by RESCUE and RESCUE-S. FIG. 139A. Schematic of edited sites at STAT3 by C to U and A to I editing (SEQ ID NO:775-778). FIG. 139B. Percent A to I editing at tyrosine residues in STAT1 and STAT3 by RESCUE and RESCUE-S. Values represent mean+/−S.E.M (n=3); NT, non-targeting guide. FIG. 139C. Percent C to U editing at serine residues in STAT1 and STAT3 by RESCUE and RESCUE-S. Values represent mean+/−S.E.M (n=3); NT, non-targeting guide.

Figure 140A:
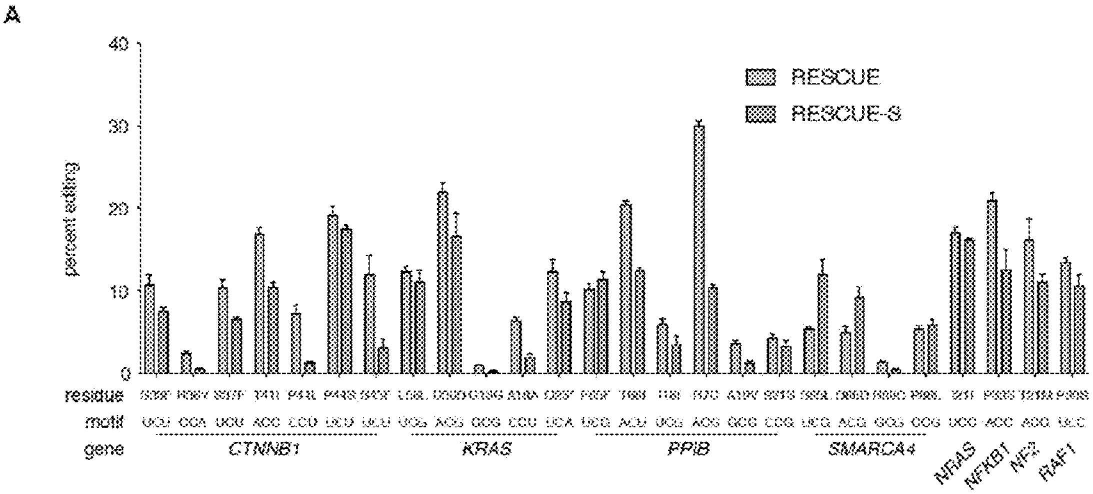
Figure 140B:
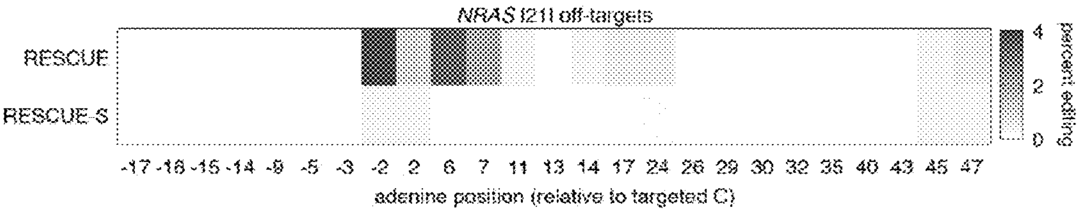
Figure 140C:
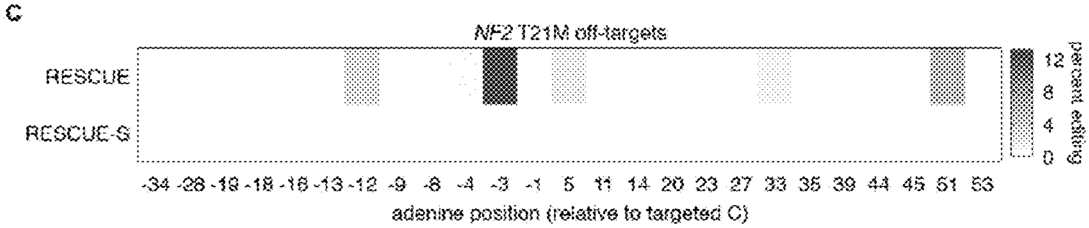
Figure 140D:
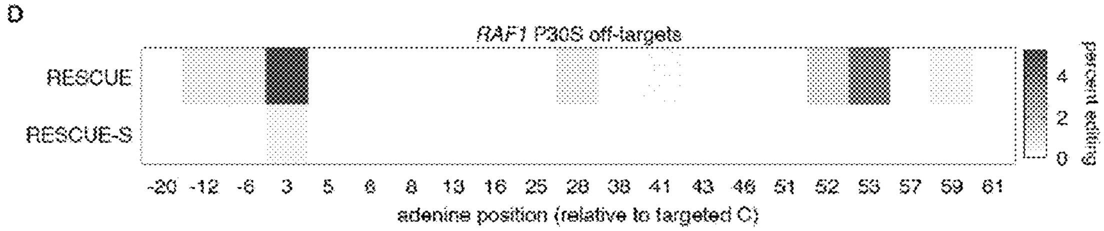
Figure 140E:
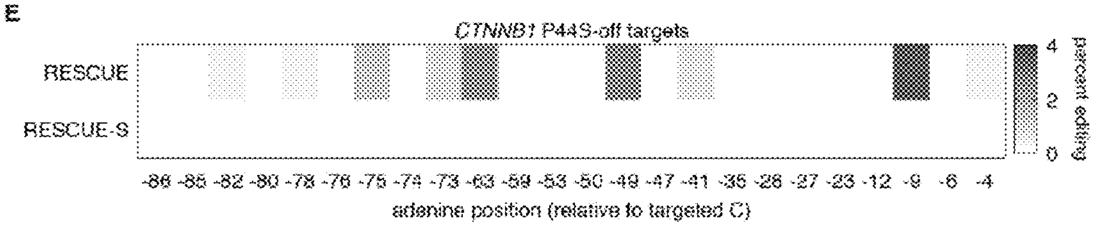

FIGS. 140A-140E On target and off-target editing of RESCUE and RESCUE-S on endogenous targets. FIG. 140A. Percent editing of endogenous target sites with varying base motifs with RESCUE and RESCUE-S. Values represent mean+/−S.E.M (n=3). FIG. 140B. Percent editing of at neighboring adenine bases in NRAS 1211 with targeting by RESCUE and RESCUE-S. FIG. 140C. Percent editing of at neighboring adenine bases in NF2 T21M with targeting by RESCUE and RESCUE-S. FIG. 140D. Percent editing of at neighboring adenine bases in RAF1 P30S with targeting by RESCUE and RESCUE-S. FIG. 140E. Percent editing of at neighboring adenine bases in CTNNB1 P44S with targeting by RESCUE and RESCUE-S.

Figure 141:
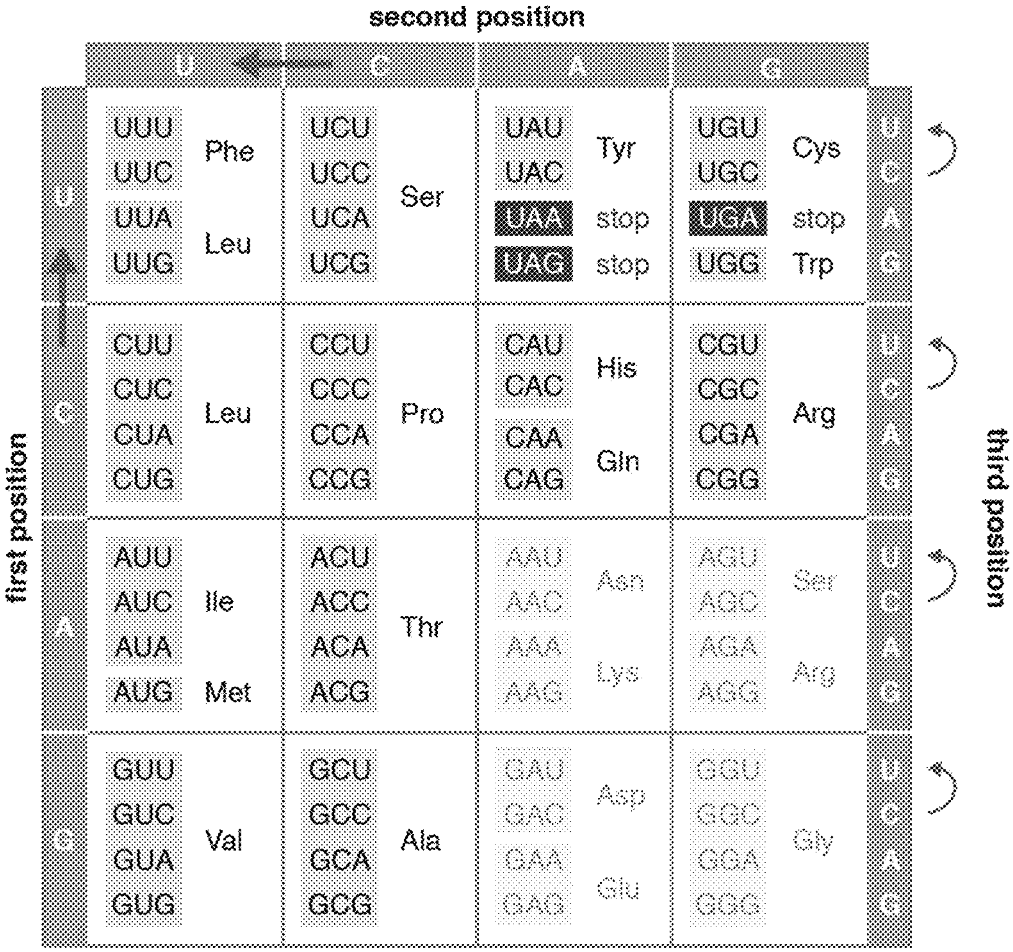

FIG. 141 Summary of amino acid changes enabled by RESCUE. Codon table showing all potential amino acid changes possible by RESCUE.

The figures herein are for illustrative purposes only and are not necessarily drawn to scale.

DETAILED DESCRIPTION OF THE EXAMPLE EMBODIMENTS

Definitions

Unless defined otherwise, technical and scientific terms used herein have the same meaning as commonly understood by one of ordinary skill in the art to which this disclosure pertains. Definitions of common terms and techniques in molecular biology may be found in Molecular Cloning: A Laboratory Manual, $2^{nd}$ edition (1989) (Sambrook, Fritsch, and Maniatis); Molecular Cloning: A Laboratory Manual, $4^{th}$ edition (2012) (Green and Sambrook); Current Protocols in Molecular Biology (1987) (F. M. Ausubel et al. eds.); the series Methods in Enzymology (Academic Press, Inc.): PCR 2: A Practical Approach (1995) (M. J. MacPherson, B. D. Hames, and G. R. Taylor eds.): Antibodies, A Laboratory Manual (1988) (Harlow and Lane, eds.): Antibodies A Laboratory Manual, $2^{nd}$ edition 2013 (E. A. Greenfield ed.); Animal Cell Culture (1987) (R. I. Freshney, ed.); Benjamin Lewin, Genes IX, published by Jones and Bartlet, 2008 (ISBN 0763752223); Kendrew et al. (eds.), The Encyclopedia of Molecular Biology, published by Blackwell Science Ltd., 1994 (ISBN 0632021829); Robert A. Meyers (ed.), Molecular Biology and Biotechnology: a Comprehensive Desk Reference, published by VCH Publishers, Inc., 1995 (ISBN 9780471185710); Singleton et al., Dictionary of Microbiology and Molecular Biology 2nd ed., J. Wiley & Sons (New York, N.Y. 1994), March, Advanced Organic Chemistry Reactions, Mechanisms and Structure 4th ed., John Wiley & Sons (New York, N.Y. 1992); and Marten H. Hofker and Jan van Deursen, Transgenic Mouse Methods and Protocols, $2^{nd}$ edition (2011).

As used herein, the singular forms “a” “an”, and “the” include both singular and plural referents unless the context clearly dictates otherwise.

The term “optional” or “optionally” means that the subsequent described event, circumstance or substituent may or may not occur, and that the description includes instances where the event or circumstance occurs and instances where it does not.

The recitation of numerical ranges by endpoints includes all numbers and fractions subsumed within the respective ranges, as well as the recited endpoints.

The terms “about” or “approximately” as used herein when referring to a measurable value such as a parameter, an amount, a temporal duration, and the like, are meant to encompass variations of and from the specified value, such as variations of +/−10% or less, +/−5% or less, +/−1% or less, and +/−0.1% or less of and from the specified value, insofar such variations are appropriate to perform in the disclosed invention. It is to be understood that the value to which the modifier “about” or “approximately” refers is itself also specifically, and preferably, disclosed.

As used herein, a “biological sample” may contain whole cells and/or live cells and/or cell debris. The biological sample may contain (or be derived from) a “bodily fluid”. The present invention encompasses embodiments wherein the bodily fluid is selected from amniotic fluid, aqueous humour, vitreous humour, bile, blood serum, breast milk, cerebrospinal fluid, cerumen (earwax), chyle, chyme, endolymph, perilymph, exudates, feces, female ejaculate, gastric acid, gastric juice, lymph, mucus (including nasal drainage and phlegm), pericardial fluid, peritoneal fluid, pleural fluid, pus, rheum, saliva, sebum (skin oil), semen, sputum, synovial fluid, sweat, tears, urine, vaginal secretion, vomit and mixtures of one or more thereof. Biological samples include cell cultures, bodily fluids, cell cultures from bodily fluids. Bodily fluids may be obtained from a mammal organism, for example by puncture, or other collecting or sampling procedures.

The terms “subject,” “individual,” and “patient” are used interchangeably herein to refer to a vertebrate, preferably a mammal, more preferably a human. Mammals include, but are not limited to, murines, simians, humans, farm animals, sport animals, and pets. Tissues, cells and their progeny of a biological entity obtained in vivo or cultured in vitro are also encompassed.

Whenever reference is made herein to Cas13, it will be understood that a mutated or engineered Cas13 according to the invention as described herein is meant, unless explicitly indicated otherwise. Whenever reference is made herein to Cas13, preferably a mutated or engineered Cas13a, Cas13b, Cas13c, or Cas13d according to the invention as described herein is meant, unless explicitly indicated otherwise. Whenever reference is made herein to Cas13, preferably a mutated or engineered Cas13b according to the invention as described herein is meant, unless explicitly indicated otherwise.

Various embodiments are described hereinafter. It should be noted that the specific embodiments are not intended as an exhaustive description or as a limitation to the broader aspects discussed herein. One aspect described in conjunction with a particular embodiment is not necessarily limited to that embodiment and can be practiced with any other embodiment(s). Reference throughout this specification to “one embodiment”, “an embodiment,” “an example embodiment,” means that a particular feature, structure or characteristic described in connection with the embodiment is included in at least one embodiment of the present invention. Thus, appearances of the phrases “in one embodiment,” “in an embodiment,” or “an example embodiment” in various places throughout this specification are not necessarily all referring to the same embodiment, but may. Furthermore, the particular features, structures or characteristics may be combined in any suitable manner, as would be apparent to a person skilled in the art from this disclosure, in one or more embodiments. Furthermore, while some embodiments described herein include some but not other features included in other embodiments, combinations of features of different embodiments are meant to be within the scope of the invention. For example, in the appended claims, any of the claimed embodiments can be used in any combination.

All publications, published patent documents, and patent applications cited herein are hereby incorporated by reference to the same extent as though each individual publication, published patent document, or patent application was specifically and individually indicated as being incorporated by reference.

Overview

In one aspect, embodiments disclosed herein are directed to an engineered CRISPR-Cas protein comprising one or more modified amino acids. In certain embodiments, the engineered CRISPR-Cas protein increases or decreases one or more of PFS recognition/specificity, gRNA binding, protease activity, polynucleotide binding capability, stability, specificity, target binding, off-target binding, and/or catalytic activity as compared to a corresponding wild-type CRISPR-Cas protein. In certain embodiments, the CRISPR-Cas protein comprises one or more HEPN domains, and comprises one or more modified amino acids. The modified amino acids may interact with a guide RNA that forms a complex with the CRISPR-Cas protein, and/or are in a HEPN active site, an inter-domain linker domain, a lid domain, a helical domain or a bridge helix domain of the CRISPR-Cas protein, or a combination thereof. In some examples, the engineered CRISPR-Cas protein comprising one or more HEPN domains and further comprising one or more modified amino acids, wherein the amino acids: interact with a guide RNA that forms a complex with the engineered CRISPR-Cas protein; are in a HEPN active site, an inter-domain linker domain, a lid domain, a helical domain 1, a helical domain 2, or a bridge helix domain of the engineered CRISPR-Cas protein; or a combination thereof.

In another aspect, embodiments disclosed herein provide a sub-set of newly identified CRISPR-Cas orthologs that are smaller in size than previously discovered CRISPR-Cas orthologs, including further modifications to and uses thereof. In particular embodiments, the CRISPR-Cas orthologs are less than about 1000 amino acids and can be optionally provided as part of a fusion protein.

Engineered nucleotide deaminases are also provided herein. In certain embodiments, the engineered nucleotide deaminases are adenosine deaminases that can be engineered to comprise cytidine deaminase activity. In embodiments, the engineered nucleotide deaminases may be fused to a Cas protein, including the CRISPR-Cas proteins disclosed herein.

In another aspect, embodiments disclosed herein include systems and uses for such modified CRISPR-Cas proteins including, but not limited to, diagnostics, base editing therapeutics and methods of detection. Fusion proteins comprising a CRISPR Cas protein, including those disclosed herein, and nucleotide deaminase may also be used for base editing. Delivery of the proteins and systems disclosed is also provided, including to a variety of cells and via a variety of particles, vesicles and vectors.

Crispr-Cas Systems in General

In general, the CRISPR-Cas or CRISPR system refers collectively to transcripts and other elements involved in the expression of or directing the activity of CRISPR-associated ("Cas") genes, including sequences encoding a Cas gene, a tracr (trans-activating CRISPR) sequence (e.g. tracrRNA or an active partial tracrRNA), a tracr-mate sequence (encompassing a "direct repeat" and a tracrRNA-processed partial direct repeat in the context of an endogenous CRISPR system), a guide sequence (also referred to as a "spacer" in the context of an endogenous CRISPR system), or "RNA(s)" as that term is herein used (e.g., RNA(s) to guide Cas, such as Cas9, e.g. CRISPR RNA and transactivating (tracr) RNA or a single guide RNA (sgRNA) (chimeric RNA)) or other sequences and transcripts from a CRISPR locus. In general, a CRISPR system is characterized by elements that promote the formation of a CRISPR complex at the site of a target sequence (also referred to as a protospacer in the context of an endogenous CRISPR system). When the CRISPR protein is a Class 2 Type VI effector, a tracrRNA is not required. In an engineered system of the invention, the direct repeat may encompass naturally-occurring sequences or non-naturally-occurring sequences. The direct repeat of the invention is not limited to naturally occurring lengths and sequences. A direct repeat can be 36nt in length, but a longer or shorter direct repeat can vary. For example, a direct repeat can be 30nt or longer, such as 30-100 nt or longer. For example, a direct repeat can be 30 nt, 40nt, 50nt, 60nt, 70nt, 70nt, 80nt, 90nt, 100nt or longer in length. In some embodiments, a direct repeat of the invention can include synthetic nucleotide sequences inserted between the 5' and 3' ends of naturally occurring direct repeats. In certain embodiments, the inserted sequence may be self-complementary, for example, 20%, 30%, 40%, 50%, 60%, 70%, 80%, 90%, or 100% self-complementary. Furthermore, a direct repeat of the invention may include insertions of nucleotides such as an aptamer or sequences that bind to an adapter protein (for association with functional domains). In certain embodiments, one end of a direct repeat containing such an insertion is roughly the first half of a short DR and the end is roughly the second half of the short DR.

The CRISPR-Cas protein (used interchangeably herein with "Cas protein", "Cas effector") may include Cas9, Cas 12 (e.g., Cas12a, Cas12b, Cas12c, Cas12d, etc.), Cas13 (e.g., Cas13a, Cas13b (such as Cas13b-t1, Cas13b-t2, Cas13b-t3), Cas13c, Cas13d, etc.), Cas14, CasX, and CasY. In some embodiments, the CRISPR-Cas protein may be a type VI CRISPR-Cas protein. For example, the Type VI CRISPR-Cas protein may be a Cas13 protein. The Cas13 protein may be Cas13a, a Cas13b, a Cas13c, or a Cas13d. In some examples, the CRISPR-Cas protein is Cas13a. In some examples, the CRISPR-Cas protein is Cas13b. In some examples, the CRISPR-Cas protein is Cas13c. In some examples, the CRISPR-Cas protein is Cas13d.

In some embodiments, an engineered CRISPR-Cas protein comprising one or more HEPN domains and is less than 1000 amino acids in length. For example, the protein may be less than 950, less than 900, less than 850, less than 800, less, or than 750 amino acids in size.

In certain example embodiments, the CRISPR-Cas protein comprises at least one HEPN domain, including but not limited to the HEPN domains described herein, HEPN domains known in the art, and domains recognized to be HEPN domains by comparison to consensus sequence motifs. Several such domains are provided herein. In one non-limiting example, a consensus sequence can be derived from the sequences of C2c2 or Cas13b orthologs provided herein. In certain example embodiments, the effector protein comprises a single HEPN domain. In certain other example embodiments, the effector protein comprises two HEPN domains.

In one example embodiment, the one or more HEPN domains comprises a RxxxxH motif. The RxxxxH motif sequence can be, without limitation, from a HEPN domain described herein or a HEPN domain known in the art. RxxxxH motif sequences further include motif sequences created by combining portions of two or more HEPN domains. As noted, consensus sequences can be derived from the sequences of the orthologs disclosed in U.S. Provisional Patent Application 62/432,240 entitled "Novel CRISPR Enzymes and Systems," U.S. Provisional Patent Application 62/471,710 entitled "Novel Type VI CRISPR Orthologs and Systems" filed on Mar. 15, 2017, and U.S. Provisional Patent Application 62,484,786 entitled "Novel Type VI CRISPR Orthologs and Systems," filed on Apr. 12, 2017.

In an embodiment of the invention, a HEPN domain comprises at least one RxxxxH motif comprising the sequence of $R\{N/H/K\}X_1X_2X_3H$. In an embodiment of the invention, a HEPN domain comprises a RxxxxH motif comprising the sequence of $R\{N/H\}X_1X_2X_3H$. In an embodiment of the invention, a HEPN domain comprises the sequence of $R\{N/K\}X_1X_2X_3H$. In certain embodiments, $X_1$ is R, S, D, E, Q, N, G, Y, or H. In certain embodiments, $X_2$ is I, S, T, V, or L. In certain embodiments, $X_3$ is L, F, N, Y, V, I, S, D, E, or A.

In the context of formation of a CRISPR complex, "target sequence" refers to a sequence to which a guide sequence is designed to have complementarity, where hybridization between a target sequence and a guide sequence promotes the formation of a CRISPR complex. A target sequence may comprise any polynucleotide, such as DNA or RNA polynucleotides. In some embodiments, a target sequence is located in the nucleus or cytoplasm of a cell. In some embodiments, direct repeats may be identified in silico by searching for repetitive motifs that fulfill any or all of the following criteria: 1. found in a 2 Kb window of genomic sequence flanking the type II CRISPR locus; 2. span from 20 to 50 bp; and 3. interspaced by 20 to 50 bp. In some embodiments, 2 of these criteria may be used, for instance 1 and 2, 2 and 3, or 1 and 3. In some embodiments, all 3 criteria may be used.

In embodiments of the invention the terms guide sequence and guide RNA, e.g., RNA capable of guiding CRISPR-Cas effector proteins to a target locus, are used interchangeably as in herein cited documents such as WO 2014/093622 (PCT/US2013/074667). In general, a guide sequence (or spacer sequence) is any polynucleotide sequence having sufficient complementarity with a target polynucleotide sequence to hybridize with the target sequence and direct sequence-specific binding of a CRISPR complex to the target sequence. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g. the Burrows Wheeler Aligner), ClustalW, Clustal X, BLAT, Novoalign (Novocraft Technologies; available at www.novocraft.com), ELAND (Illumina, San Diego, CA), SOAP (available at soap.genomics.org.cn), and Maq (available at maq.sourceforge.net). In some embodiments, a guide sequence (or spacer sequence) is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20, 15, 12, or fewer nucleotides in length. Preferably the guide sequence is 10-40 nucleotides long, such as 20-30 or 20-40 nucleotides long or longer, such as 30 nucleotides long or about 30 nucleotides long. In certain embodiments, the guide sequence is 10-30 nucleotides long, such as 20-30 or 20-40 nucleotides long or longer, such as 30 nucleotides long or about 30 nucleotides long for CRISPR-Cas effectors. In certain embodiments, the guide sequence is 10-30 nucleotides long, such as 20-30 nucleotides long, such as 30 nucleotides long. The ability of a guide sequence to direct sequence-specific binding of a CRISPR complex to a target sequence may be assessed by any suitable assay. For example, the components of a CRISPR system sufficient to form a CRISPR complex, including the guide sequence to be tested, may be provided to a host cell having the corresponding target sequence, such as by transfection with vectors encoding the components of the CRISPR sequence, followed by an assessment of preferential cleavage within the target sequence, such as by Surveyor assay as described herein. Similarly, cleavage of a target polynucleotide sequence may be evaluated in a test tube by providing the target sequence, components of a CRISPR complex, including the guide sequence to be tested and a control guide sequence different from the test guide sequence, and comparing binding or rate of cleavage at the target sequence between the test and control guide sequence reactions. Other assays are possible, and will occur to those skilled in the art.

In a classic CRISPR-Cas systems, the degree of complementarity between a guide sequence and its corresponding target sequence can be about or more than about 50%, 60%, 75%, 80%, 85%, 90%, 95%, 97.5%, 99%, or 100%; a guide or RNA or crRNA can be about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length; or guide or RNA or crRNA can be less than about 75, 50, 45, 40, 35, 30, 25, 20, 15, 12, or fewer nucleotides in length; and advantageously tracr RNA is 30 or 50 nucleotides in length. However, an aspect of the invention is to reduce off-target interactions, e.g., reduce the guide interacting with a target sequence having low complementarity. Indeed, in the examples, it is shown that the invention involves mutations that result in the CRISPR-Cas system being able to distinguish between target and off-target sequences that have greater than 80% to about 95% complementarity, e.g., 83%-84% or 88-89% or 94-95% complementarity (for instance, distinguishing between a target having 18 nucleotides from an off-target of 18 nucleotides having 1, 2 or 3 mismatches). Accordingly, in the context of the present invention the degree of complementarity between a guide sequence and its corresponding target sequence is greater than 94.5% or 95% or 95.5% or 96% or 96.5% or 97% or 97.5% or 98% or 98.5% or 99% or 99.5% or 99.9%, or 100%. Off target is less than 100% or 99.9% or 99.5% or 99% or 99% or 98.5% or 98% or 97.5% or 97% or 96.5% or 96% or 95.5% or 95% or 94.5% or 94% or 93% or 92% or 91% or 90% or 89% or 88% or 87% or 86% or 85% or 84% or 83% or 82% or 81% or 80% complementarity between the sequence and the guide, with it advantageous that off target is 100% or 99.9% or 99.5% or 99% or 99% or 98.5% or 98% or 97.5% or 97% or 96.5% or 96% or 95.5% or 95% or 94.5% complementarity between the sequence and the guide.

In certain embodiments, modulations of cleavage efficiency can be exploited by introduction of mismatches, e.g. 1 or more mismatches, such as 1 or 2 mismatches between spacer sequence and target sequence, including the position of the mismatch along the spacer/target. The more central (i.e. not 3' or 5') for instance a double mismatch is, the more cleavage efficiency is affected. Accordingly, by choosing mismatch position along the spacer, cleavage efficiency can be modulated. By means of example, if less than 100% cleavage of targets is desired (e.g. in a cell population), 1 or more, such as preferably 2 mismatches between spacer and target sequence may be introduced in the spacer sequences. The more central along the spacer of the mismatch position, the lower the cleavage percentage.

The methods according to the invention as described herein comprehend inducing one or more nucleotide modifications in a eukaryotic cell (in vitro, i.e. in an isolated eukaryotic cell) as herein discussed comprising delivering to cell a vector as herein discussed. The mutation(s) can include the introduction, deletion, or substitution of one or more nucleotides at each target sequence of cell(s) via the guide(s) RNA(s) or sgRNA(s). The mutations can include the introduction, deletion, or substitution of 1-75 nucleotides at each target sequence of said cell(s) via the guide(s) RNA(s). The mutations can include the introduction, deletion, or substitution of 1, 5, 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s). The mutations can include the introduction, deletion, or substitution of 5, 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s). The mutations include the introduction, deletion, or substitution of 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s). The mutations can include the introduction, deletion, or substitution of 20, 21, 22, 23, 24, 25, 26, 27, 28, 29, 30, 35, 40, 45, 50, or 75 nucleotides at each target sequence of said cell(s) via the guide(s) RNA(s). The mutations can include the introduction, deletion, or substitution of 40, 45, 50, 75, 100, 200, 300, 400 or 500 nucleotides at each target sequence of said cell(s) via the guide(s) RNA(s).

For minimization of toxicity and off-target effect, it will be important to control the concentration of Cas mRNA or protein and guide RNA delivered. Optimal concentrations of Cas mRNA or protein and guide RNA can be determined by testing different concentrations in a cellular or non-human eukaryote animal model and using deep sequencing the analyze the extent of modification at potential off-target genomic loci.

Typically, in the context of an endogenous CRISPR system, formation of a CRISPR complex (comprising a guide sequence hybridized to a target sequence and complexed with one or more Cas proteins) results in cleavage in or near (e.g. within 1, 2, 3, 4, 5, 6, 7, 8, 9, 10, 20, 50, or more base pairs from) the target sequence, but may depend on for instance secondary structure, in particular in the case of RNA targets. In some cases, in the context of an endogenous CRISPR system, formation of a CRISPR complex (comprising a guide sequence hybridized to a target sequence and complexed with one or more Cas proteins) results in cleavage of one or both strands (if applicable) in or near (e.g. within 1, 2, 3, 4, 5, 6, 7, 8, 9, 10, 20, 50, or more base pairs from) the target sequence.

In particularly preferred embodiments according to the invention, the guide RNA (capable of guiding Cas to a target locus) may comprise (1) a guide sequence capable of hybridizing to a target locus (a polynucleotide target locus, such as an RNA target locus) in the eukaryotic cell; (2) a direct repeat (DR) sequence) which reside in a single RNA, i.e. an sgRNA (arranged in a 5' to 3' orientation) or crRNA.

With respect to general information on CRISPR-Cas Systems, components thereof, and delivery of such components, including methods, materials, delivery vehicles, vectors, particles, AAV, and making and using thereof, including as to amounts and formulations, all useful in the practice of the instant invention, reference is made to: U.S. Pat. Nos. 8,999,641, 8,993,233, 8,945,839, 8,932,814, 8,906,616, 8,895,308, 8,889,418, 8,889,356, 8,871,445, 8,865,406, 8,795,965, 8,771,945 and 8,697,359; US Patent Publications US 2014-0310830 (U.S. application Ser. No. 14/105,031), US 2014-0287938 A1 (U.S. application Ser. No. 14/213,991), US 2014-0273234 A1 (U.S. application Ser. No. 14/293,674), US2014-0273232 A1 (U.S. application Ser. No. 14/290,575), US 2014-0273231 (U.S. application Ser. No. 14/259,420), US 2014-0256046 A1 (U.S. application Ser. No. 14/226,274), US 2014-0248702 A1 (U.S. application Ser. No. 14/258,458), US 2014-0242700 A1 (U.S. application Ser. No. 14/222,930), US 2014-0242699 A1 (U.S. application Ser. No. 14/183,512), US 2014-0242664 A1 (U.S. application Ser. No. 14/104,990), US 2014-0234972 A1 (U.S. application Ser. No. 14/183,471), US 2014-0227787 A1 (U.S. application Ser. No. 14/256,912), US 2014-0189896 A1 (U.S. application Ser. No. 14/105,035), US 2014-0186958 (U.S. application Ser. No. 14/105,017), US 2014-0186919 A1 (U.S. application Ser. No. 14/104,977), US 2014-0186843 A1 (U.S. application Ser. No. 14/104,900), US 2014-0179770 A1 (U.S. application Ser. No. 14/104,837) and US 2014-0179006 A1 (U.S. application Ser. No. 14/183,486), US 2014-0170753 (U.S. application Ser. No. 14/183,429); European Patents EP 2 784 162 B1 and EP 2 771 468 B1; European Patent Applications EP 2 771 468 (EP13818570.7), EP 2 764 103 (EP13824232.6), and EP 2 784 162 (EP14170383.5); and PCT Patent Publications PCT Patent Publications WO 2014/093661 (PCT/US2013/074743), WO 2014/093694 (PCT/US2013/074790), WO 2014/093595 (PCT/US2013/074611), WO 2014/093718 (PCT/US2013/074825), WO 2014/093709 (PCT/US2013/074812), WO 2014/093622 (PCT/US2013/074667), WO 2014/093635 (PCT/US2013/074691), WO 2014/093655 (PCT/US2013/074736), WO 2014/093712 (PCT/US2013/074819), WO 2014/093701 (PCT/US2013/074800), WO 2014/018423 (PCT/US2013/051418), WO 2014/204723 (PCT/US2014/041790), WO 2014/204724 (PCT/US2014/041800), WO 2014/204725 (PCT/US2014/041803), WO 2014/204726 (PCT/US2014/041804), WO 2014/204727 (PCT/US2014/041806), WO 2014/204728 (PCT/US2014/041808), WO 2014/204729 (PCT/US2014/041809). Reference is also made to U.S. provisional patent applications 61/758,468; 61/802,174; 61/806,375; 61/814,263; 61/819,803 and 61/828,130, filed on Jan. 30, 2013; Mar. 15, 2013; Mar. 28, 2013; Apr. 20, 2013; May 6, 2013 and May 28, 2013 respectively. Reference is also made to U.S. provisional patent application 61/836,123, filed on Jun. 17, 2013. Reference is additionally made to U.S. provisional patent applications 61/835,931, 61/835,936, 61/836,127, 61/836,101, 61/836,080 and 61/835,973, each filed Jun. 17, 2013. Further reference is made to U.S. provisional patent applications 61/862,468 and 61/862,355 filed on Aug. 5, 2013; 61/871,301 filed on Aug. 28, 2013; 61/960,777 filed on Sep. 25, 2013 and 61/961,980 filed on Oct. 28, 2013. Reference is yet further made to: PCT Patent applications Nos: PCT/US2014/041803, PCT/US2014/041800, PCT/US2014/041809, PCT/US2014/041804 and PCT/US2014/041806, each filed Jun. 10, 2014; PCT/US2014/041808 filed Jun. 11, 2014; and PCT/US2014/62558 filed Oct. 28, 2014, and U.S. Provisional Patent Applications Ser. Nos. 61/915,150, 61/915,301, 61/915,267 and 61/915,260, each filed Dec. 12, 2013; 61/757,972 and 61/768,959, filed on Jan. 29, 2013 and Feb. 25, 2013; 61/835,936, 61/836,127, 61/836,101, 61/836,080, 61/835,973, and 61/835,931, filed Jun. 17, 2013; 62/010,888 and 62/010,879, both filed Jun. 11, 2014; 62/010,329 and 62/010,441, each filed Jun. 10, 2014; 61/939,228 and 61/939,242, each filed Feb. 12, 2014; 61/980,012, filed Apr. 15, 2014; 62/038,358, filed Aug. 17, 2014; 62/054,490, 62/055,484, 62/055,460 and 62/055,487, each filed Sep. 25, 2014; and 62/069,243, filed Oct. 27, 2014. Reference is also made to U.S. provisional patent applications Nos. 62/055,484, 62/055,460, and 62/055,487, filed Sep. 25, 2014; U.S. provisional patent application 61/980,012, filed Apr. 15, 2014; and U.S. provisional patent application 61/939,242 filed Feb. 12, 2014. Reference is made to PCT application designating, inter alia, the United States, application No. PCT/US14/41806, filed Jun. 10, 2014. Reference is made to U.S. provisional patent application 61/930,214 filed on Jan. 22, 2014. Reference is made to U.S. provisional patent applications 61/915,251; 61/915,260 and 61/915,267, each filed on Dec. 12, 2013. Reference is made to U.S. provisional patent application Ser. No. 61/980,012 filed Apr. 15, 2014. Reference is made to PCT application designating, inter alia, the United States, application No. PCT/US14/41806, filed Jun. 10, 2014. Reference is made to U.S. provisional patent application 61/930,214 filed on Jan. 22, 2014. Reference is made to U.S. provisional patent applications 61/915,251; 61/915,260 and 61/915,267, each filed on Dec. 12, 2013.

Mention is also made of U.S. application 62/091,455, filed, 12 Dec. 2014, PROTECTED GUIDE RNAS (PGRNAS); U.S. application 62/096,708, 24 Dec. 2014, PROTECTED GUIDE RNAS (PGRNAS); U.S. application 62/091,462, 12 Dec. 2014, DEAD GUIDES FOR CRISPR TRANSCRIPTION FACTORS; U.S. application 62/096,324, 23 Dec. 2014, DEAD GUIDES FOR CRISPR TRANSCRIPTION FACTORS; U.S. application 62/091,456, 12 Dec. 2014, ESCORTED AND FUNCTIONALIZED GUIDES FOR CRISPR-CAS SYSTEMS; U.S. application 62/091,461, 12 Dec. 2014, DELIVERY, USE AND THERAPEUTIC APPLICATIONS OF THE CRISPR-CAS SYSTEMS AND COMPOSITIONS FOR GENOME EDITING AS TO HEMATOPOETIC STEM CELLS (HSCs); U.S. application 62/094,903, 19 Dec. 2014, UNBIASED IDENTIFICATION OF DOUBLE-STRAND BREAKS AND GENOMIC REARRANGEMENT BY GENOME-WISE INSERT CAPTURE SEQUENCING; U.S. application 62/096,761, 24 Dec. 2014, ENGINEERING OF SYSTEMS, METHODS AND OPTIMIZED ENZYME AND GUIDE SCAFFOLDS FOR SEQUENCE MANIPULATION; U.S. application 62/098,059, 30 Dec. 2014, RNA-TARGETING SYSTEM; U.S. application 62/096,656, 24 Dec. 2014, CRISPR HAVING OR ASSOCIATED WITH DESTABILIZATION DOMAINS; U.S. application 62/096,697, 24 Dec. 2014, CRISPR HAVING OR ASSOCIATED WITH AAV; U.S. application 62/098,158, 30 Dec. 2014, ENGINEERED CRISPR COMPLEX INSERTIONAL TARGETING SYSTEMS; U.S. application 62/151,052, 22 Apr. 2015, CELLULAR TARGETING FOR EXTRACELLULAR EXOSOMAL REPORTING; U.S. application 62/054,490, 24 Sep. 2014, DELIVERY, USE AND THERAPEUTIC APPLICATIONS OF THE CRISPR-CAS SYSTEMS AND COMPOSITIONS FOR TARGETING DISORDERS AND DISEASES USING PARTICLE DELIVERY COMPONENTS; U.S. application 62/055,484, 25 Sep. 2014, SYSTEMS, METHODS AND COMPOSITIONS FOR SEQUENCE MANIPULATION WITH OPTIMIZED FUNCTIONAL CRISPR-CAS SYSTEMS; U.S. application 62/087,537, 4 Dec. 2014, SYSTEMS, METHODS AND COMPOSITIONS FOR SEQUENCE MANIPULATION WITH OPTIMIZED FUNCTIONAL CRISPR-CAS SYSTEMS; U.S. application 62/054,651, 24 Sep. 2014, DELIVERY, USE AND THERAPEUTIC APPLICATIONS OF THE CRISPR-CAS SYSTEMS AND COMPOSITIONS FOR MODELING COMPETITION OF MULTIPLE CANCER MUTATIONS IN VIVO; U.S. application 62/067,886, 23 Oct. 2014, DELIVERY, USE AND THERAPEUTIC APPLICATIONS OF THE CRISPR-CAS SYSTEMS AND COMPOSITIONS FOR MODELING COMPETITION OF MULTIPLE CANCER MUTATIONS IN VIVO; U.S. application 62/054,675, 24 Sep. 2014, DELIVERY, USE AND THERAPEUTIC APPLICATIONS OF THE CRISPR-CAS SYSTEMS AND COMPOSITIONS IN NEURONAL CELLS/TISSUES; U.S. application 62/054,528, 24 Sep. 2014, DELIVERY, USE AND THERAPEUTIC APPLICATIONS OF THE CRISPR-CAS SYSTEMS AND COMPOSITIONS IN IMMUNE DISEASES OR DISORDERS; U.S. application 62/055,454, 25 Sep. 2014, DELIVERY, USE AND THERAPEUTIC APPLICATIONS OF THE CRISPR-CAS SYSTEMS AND COMPOSITIONS FOR TARGETING DISORDERS AND DISEASES USING CELL PENETRATION PEPTIDES (CPP); U.S. application 62/055,460, 25 Sep. 2014, MULTIFUNCTIONAL-CRISPR COMPLEXES AND/OR OPTIMIZED ENZYME LINKED FUNCTIONAL-CRISPR COMPLEXES; U.S. application 62/087,475, 4 Dec. 2014, FUNCTIONAL SCREENING WITH OPTIMIZED FUNCTIONAL CRISPR-CAS SYSTEMS; U.S. application 62/055,487, 25 Sep. 2014, FUNCTIONAL SCREENING WITH OPTIMIZED FUNCTIONAL CRISPR-CAS SYSTEMS; U.S. application 62/087,546, 4 Dec. 2014, MULTIFUNCTIONAL CRISPR COMPLEXES AND/OR OPTIMIZED ENZYME LINKED FUNCTIONAL-CRISPR COMPLEXES; and U.S. application 62/098,285, 30 Dec. 2014, CRISPR MEDIATED IN VIVO MODELING AND GENETIC SCREENING OF TUMOR GROWTH AND METASTASIS.

Also with respect to general information on CRISPR-Cas Systems, mention is made of the following (also hereby incorporated herein by reference):

Multiplex genome engineering using CRISPR/Cas systems. Cong, L., Ran, F. A., Cox, D., Lin, S., Barretto, R., Habib, N., Hsu, P. D., Wu, X., Jiang, W., Marraffini, L. A., & Zhang, F. Science February 15; 339(6121):819-23 (2013);

RNA-guided editing of bacterial genomes using CRISPR-Cas systems. Jiang W., Bikard D., Cox D., Zhang F, Marraffini L A. Nat Biotechnol March; 31(3):233-9 (2013);

One-Step Generation of Mice Carrying Mutations in Multiple Genes by CRISPR/Cas-Mediated Genome Engineering. Wang H., Yang H., Shivalila C S., Dawlaty M M., Cheng A W., Zhang F., Jaenisch R. Cell May 9; 153(4): 910-8 (2013);

Optical control of mammalian endogenous transcription and epigenetic states. Konermann S, Brigham M D, Trevino A E, Hsu P D, Heidenreich M, Cong L, Platt R J, Scott D A, Church G M, Zhang F. Nature. August 22; 500(7463): 472-6. doi: 10.1038/Nature12466. Epub 2013 Aug. 23 (2013);

Double Nicking by RNA-Guided CRISPR Cas9 for Enhanced Genome Editing Specificity. Ran, F A., Hsu, P D., Lin, C Y., Gootenberg, J S., Konermann, S., Trevino, A E., Scott, D A., Inoue, A., Matoba, S., Zhang, Y., & Zhang, F. Cell August 28. pii: S0092-8674(13)01015-5 (2013-A);

DNA targeting specificity of RNA-guided Cas9 nucleases. Hsu, P., Scott, D., Weinstein, J., Ran, F A., Konermann, S., Agarwala, V., Li, Y., Fine, E., Wu, X., Shalem, O., Cradick, T J., Marraffini, L A., Bao, G., & Zhang, F. Nat Biotechnol doi:10.1038/nbt.2647 (2013);

Genome engineering using the CRISPR-Cas9 system. Ran, F A., Hsu, P D., Wright, J., Agarwala, V., Scott, D A., Zhang, F. Nature Protocols November; 8(11):2281-308 (2013-B);

Genome-Scale CRISPR-Cas9 Knockout Screening in Human Cells. Shalem, O., Sanjana, N E., Hartenian, E., Shi, X., Scott, D A., Mikkelson, T., Heckl, D., Ebert, B L., Root, D E., Doench, J G., Zhang, F. Science December 12. (2013). [Epub ahead of print];

Crystal structure of cas9 in complex with guide RNA and target DNA. Nishimasu, H., Ran, F A., Hsu, P D., Konermann, S., Shehata, S I., Dohmae, N., Ishitani, R., Zhang, F., Nureki, O. Cell February 27, 156(5):935-49 (2014);

Genome-wide binding of the CRISPR endonuclease Cas9 in mammalian cells. Wu X., Scott D A., Kriz A J., Chiu A C., Hsu P D., Dadon D B., Cheng A W., Trevino A E., Konermann S., Chen S., Jaenisch R., Zhang F., Sharp P A. Nat Biotechnol. April 20. doi: 10.1038/nbt.2889 (2014);

CRISPR-Cas9 Knockin Mice for Genome Editing and Cancer Modeling. Platt R J, Chen S, Zhou Y, Yim M J, Swiech L, Kempton H R, Dahlman J E, Parnas O, Eisenhaure T M, Jovanovic M, Graham D B, Jhunjhunwala S, Heidenreich M, Xavier R J, Langer R, Anderson D G, Hacohen N, Regev A, Feng G, Sharp P A, Zhang F. Cell 159(2): 440-455 DOI: 10.1016/j.cell.2014.09.014(2014);

Development and Applications of CRISPR-Cas9 for Genome Engineering, Hsu P D, Lander E S, Zhang F., Cell. June 5; 157(6):1262-78 (2014).

Genetic screens in human cells using the CRISPR/Cas9 system, Wang T, Wei J J, Sabatini D M, Lander E S., Science. January 3; 343(6166): 80-84. doi:10.1126/science.1246981 (2014);

Rational design of highly active sgRNAs for CRISPR-Cas9-mediated gene inactivation, Doench J G, Hartenian E, Graham D B, Tothova Z, Hegde M, Smith I, Sullender M, Ebert B L, Xavier R J, Root D E., (published online 3 Sep. 2014) Nat Biotechnol. December; 32(12):1262-7 (2014);

In vivo interrogation of gene function in the mammalian brain using CRISPR-Cas9, Swiech L, Heidenreich M, Banerjee A, Habib N, Li Y, Trombetta J, Sur M, Zhang F., (published online 19 Oct. 2014) Nat Biotechnol. January; 33(1):102-6 (2015);

Genome-scale transcriptional activation by an engineered CRISPR-Cas9 complex, Konermann S, Brigham M D, Trevino A E, Joung J, Abudayyeh 00, Barcena C, Hsu P D, Habib N, Gootenberg J S, Nishimasu H, Nureki O, Zhang F., Nature. January 29; 517(7536):583-8 (2015).

A split-Cas9 architecture for inducible genome editing and transcription modulation, Zetsche B, Volz S E, Zhang F., (published online 2 Feb. 2015) Nat Biotechnol. February; 33(2):139-42 (2015);

Genome-wide CRISPR Screen in a Mouse Model of Tumor Growth and Metastasis, Chen S, Sanjana N E, Zheng K, Shalem O, Lee K, Shi X, Scott D A, Song J, Pan J Q, Weissleder R, Lee H, Zhang F, Sharp P A. Cell 160, 1246-1260, Mar. 12, 2015 (multiplex screen in mouse), and In vivo genome editing using *Staphylococcus aureus* Cas9, Ran F A, Cong L, Yan W X, Scott D A, Gootenberg J S, Kriz A J, Zetsche B, Shalem O, Wu X, Makarova K S, Koonin E V, Sharp P A, Zhang F., (published online 1 Apr. 2015), Nature. April 9; 520(7546):186-91(2015).

Shalem et al., "High-throughput functional genomics using CRISPR-Cas9," Nature Reviews Genetics 16, 299-311 (May 2015).

Xu et al., "Sequence determinants of improved CRISPR sgRNA design," Genome Research 25, 1147-1157 (August 2015).

Parnas et al., "A Genome-wide CRISPR Screen in Primary Immune Cells to Dissect Regulatory Networks," Cell 162, 675-686 (Jul. 30, 2015).

Ramanan et al., CRISPR/Cas9 cleavage of viral DNA efficiently suppresses hepatitis B virus," Scientific Reports 5:10833. doi: 10.1038/srep10833 (Jun. 2, 2015)

Nishimasu et al., Crystal Structure of *Staphylococcus aureus* Cas9," Cell 162, 1113-1126 (Aug. 27, 2015)

Zetsche et al. (2015), "Cpf1 is a single RNA-guided endonuclease of a class 2 CRISPR-Cas system," Cell 163, 759-771 (Oct. 22, 2015) doi: 10.1016/j.cell.2015.09.038. Epub Sep. 25, 2015

Shmakov et al. (2015), "Discovery and Functional Characterization of Diverse Class 2 CRISPR-Cas Systems," Molecular Cell 60, 385-397 (Nov. 5, 2015) doi: 10.1016/j.molcel.2015.10.008. Epub Oct. 22, 2015

Dahlman et al., "Orthogonal gene control with a catalytically active Cas9 nuclease," Nature Biotechnology 33, 1159-1161 (November, 2015)

Gao et al, "Engineered Cpf1 Enzymes with Altered PAM Specificities," bioRxiv 091611; doi: dx.doi.org/10.1101/091611 Epub Dec. 4, 2016

Smargon et al. (2017), "Cas13b Is a Type VI-B CRISPR-Associated RNA-Guided RNase Differentially Regulated by Accessory Proteins Csx27 and Csx28," Molecular Cell 65, 618-630 (Feb. 16, 2017) doi: 10.1016/j.molcel.2016.12.023. Epub Jan. 5, 2017 each of which is incorporated herein by reference, may be considered in the practice of the instant invention, and discussed briefly below:

Cong et al. engineered type II CRISPR-Cas systems for use in eukaryotic cells based on both *Streptococcus thermophilus* Cas9 and also *Streptococcus pyogenes* Cas9 and demonstrated that Cas9 nucleases can be directed by short RNAs to induce precise cleavage of DNA in human and mouse cells. Their study further showed that Cas9 as converted into a nicking enzyme can be used to facilitate homology-directed repair in eukaryotic cells with minimal mutagenic activity. Additionally, their study demonstrated that multiple guide sequences can be encoded into a single CRISPR array to enable simultaneous editing of several at endogenous genomic loci sites within the mammalian genome, demonstrating easy programmability and wide applicability of the RNA-guided nuclease technology. This ability to use RNA to program sequence specific DNA cleavage in cells defined a new class of genome engineering tools. These studies further showed that other CRISPR loci are likely to be transplantable into mammalian cells and can also mediate mammalian genome cleavage. Importantly, it can be envisaged that several aspects of the CRISPR-Cas system can be further improved to increase its efficiency and versatility.

Jiang et al. used the clustered, regularly interspaced, short palindromic repeats (CRISPR)-associated Cas9 endonuclease complexed with dual-RNAs to introduce precise mutations in the genomes of *Streptococcus pneumoniae* and *Escherichia coli*. The approach relied on dual-RNA:Cas9-directed cleavage at the targeted genomic site to kill unmutated cells and circumvents the need for selectable markers or counter-selection systems. The study reported reprogramming dual-RNA:Cas9 specificity by changing the sequence of short CRISPR RNA (crRNA) to make single- and multinucleotide changes carried on editing templates. The study showed that simultaneous use of two crRNAs enabled multiplex mutagenesis. Furthermore, when the approach was used in combination with recombineering, in *S. pneumoniae*, nearly 100% of cells that were recovered using the described approach contained the desired mutation, and in *E. coli*, 65% that were recovered contained the mutation.

Wang et al. (2013) used the CRISPR/Cas system for the one-step generation of mice carrying mutations in multiple genes which were traditionally generated in multiple steps by sequential recombination in embryonic stem cells and/or time-consuming intercrossing of mice with a single mutation. The CRISPR/Cas system will greatly accelerate the in vivo study of functionally redundant genes and of epistatic gene interactions.

Konermann et al. (2013) addressed the need in the art for versatile and robust technologies that enable optical and chemical modulation of DNA-binding domains based CRISPR Cas9 enzyme and also Transcriptional Activator Like Effectors Ran et al. (2013-A) described an approach that combined a Cas9 nickase mutant with paired guide RNAs to introduce targeted double-strand breaks. This addresses the issue of the Cas9 nuclease from the microbial CRISPR-Cas system being targeted to specific genomic loci by a guide sequence, which can tolerate certain mismatches to the DNA target and thereby promote undesired off-target mutagenesis. Because individual nicks in the genome are repaired with high fidelity, simultaneous nicking via appropriately offset guide RNAs is required for double-stranded breaks and extends the number of specifically recognized bases for target cleavage. The authors demonstrated that using paired nicking can reduce off-target activity by 50- to 1,500-fold in cell lines and to facilitate gene knockout in mouse zygotes without sacrificing on-target cleavage efficiency. This versatile strategy enables a wide variety of genome editing applications that require high specificity.

Hsu et al. (2013) characterized SpCas9 targeting specificity in human cells to inform the selection of target sites and avoid off-target effects. The study evaluated >700 guide RNA variants and SpCas9-induced indel mutation levels at >100 predicted genomic off-target loci in 293T and 293FT cells. The authors that SpCas9 tolerates mismatches between guide RNA and target DNA at different positions in a sequence-dependent manner, sensitive to the number, position and distribution of mismatches. The authors further showed that SpCas9-mediated cleavage is unaffected by DNA methylation and that the dosage of SpCas9 and sgRNA can be titrated to minimize off-target modification. Additionally, to facilitate mammalian genome engineering applications, the authors reported providing a web-based software tool to guide the selection and validation of target sequences as well as off-target analyses.

Ran et al. (2013-B) described a set of tools for Cas9-mediated genome editing via non-homologous end joining (NHEJ) or homology-directed repair (HDR) in mammalian cells, as well as generation of modified cell lines for downstream functional studies. To minimize off-target cleavage, the authors further described a double-nicking strategy using the Cas9 nickase mutant with paired guide RNAs. The protocol provided by the authors experimentally derived guidelines for the selection of target sites, evaluation of cleavage efficiency and analysis of off-target activity. The studies showed that beginning with target design, gene modifications can be achieved within as little as 1-2 weeks, and modified clonal cell lines can be derived within 2-3 weeks.

Shalem et al. described a new way to interrogate gene function on a genome-wide scale. Their studies showed that delivery of a genome-scale CRISPR-Cas9 knockout (GeCKO) library targeted 18,080 genes with 64,751 unique guide sequences enabled both negative and positive selection screening in human cells. First, the authors showed use of the GeCKO library to identify genes essential for cell viability in cancer and pluripotent stem cells. Next, in a melanoma model, the authors screened for genes whose loss is involved in resistance to vemurafenib, a therapeutic that inhibits mutant protein kinase BRAF. Their studies showed that the highest-ranking candidates included previously validated genes NF1 and MED12 as well as novel hits NF2, CUL3, TADA2B, and TADA1. The authors observed a high level of consistency between independent guide RNAs targeting the same gene and a high rate of hit confirmation, and thus demonstrated the promise of genome-scale screening with Cas9.

Nishimasu et al. reported the crystal structure of *Streptococcus pyogenes* Cas9 in complex with sgRNA and its target DNA at 2.5 A° resolution. The structure revealed a bilobed architecture composed of target recognition and nuclease lobes, accommodating the sgRNA:DNA heteroduplex in a positively charged groove at their interface. Whereas the recognition lobe is essential for binding sgRNA and DNA, the nuclease lobe contains the HNH and RuvC nuclease domains, which are properly positioned for cleavage of the complementary and non-complementary strands of the target DNA, respectively. The nuclease lobe also contains a carboxyl-terminal domain responsible for the interaction with the protospacer adjacent motif (PAM). This high-resolution structure and accompanying functional analyses have revealed the molecular mechanism of RNA-guided DNA targeting by Cas9, thus paving the way for the rational design of new, versatile genome-editing technologies.

Wu et al. mapped genome-wide binding sites of a catalytically inactive Cas9 (dCas9) from *Streptococcus pyogenes* loaded with single guide RNAs (sgRNAs) in mouse embryonic stem cells (mESCs). The authors showed that each of the four sgRNAs tested targets dCas9 to between tens and thousands of genomic sites, frequently characterized by a 5-nucleotide seed region in the sgRNA and an NGG protospacer adjacent motif (PAM). Chromatin inaccessibility decreases dCas9 binding to other sites with matching seed sequences; thus 70% of off-target sites are associated with genes. The authors showed that targeted sequencing of 295 dCas9 binding sites in mESCs transfected with catalytically active Cas9 identified only one site mutated above background levels. The authors proposed a two-state model for Cas9 binding and cleavage, in which a seed match triggers binding but extensive pairing with target DNA is required for cleavage.

Platt et al. established a Cre-dependent Cas9 knockin mouse. The authors demonstrated in vivo as well as ex vivo genome editing using adeno-associated virus (AAV)-, lentivirus-, or particle-mediated delivery of guide RNA in neurons, immune cells, and endothelial cells.

Hsu et al. (2014) is a review article that discusses generally CRISPR-Cas9 history from yogurt to genome editing, including genetic screening of cells.

Wang et al. (2014) relates to a pooled, loss-of-function genetic screening approach suitable for both positive and negative selection that uses a genome-scale lentiviral single guide RNA (sgRNA) library.

Doench et al. created a pool of sgRNAs, tiling across all possible target sites of a panel of six endogenous mouse and three endogenous human genes and quantitatively assessed their ability to produce null alleles of their target gene by antibody staining and flow cytometry. The authors showed that optimization of the PAM improved activity and also provided an on-line tool for designing sgRNAs.

Swiech et al. demonstrate that AAV-mediated SpCas9 genome editing can enable reverse genetic studies of gene function in the brain.

Konermann et al. (2015) discusses the ability to attach multiple effector domains, e.g., transcriptional activator, functional and epigenomic regulators at appropriate positions on the guide such as stem or tetraloop with and without linkers.

Zetsche et al. demonstrates that the Cas9 enzyme can be split into two and hence the assembly of Cas9 for activation can be controlled.

Chen et al. relates to multiplex screening by demonstrating that a genome-wide in vivo CRISPR-Cas9 screen in mice reveals genes regulating lung metastasis.

Ran et al. (2015) relates to SaCas9 and its ability to edit genomes and demonstrates that one cannot extrapolate from biochemical assays. Shalem et al. (2015) described ways in which catalytically inactive Cas9 (dCas9) fusions are used to synthetically repress (CRISPRi) or activate (CRISPRa) expression, showing. advances using Cas9 for genome-scale screens, including arrayed and pooled screens, knockout approaches that inactivate genomic loci and strategies that modulate transcriptional activity.

End Edits

Shalem et al. (2015) described ways in which catalytically inactive Cas9 (dCas9) fusions are used to synthetically repress (CRISPRi) or activate (CRISPRa) expression, showing. advances using Cas9 for genome-scale screens, including arrayed and pooled screens, knockout approaches that inactivate genomic loci and strategies that modulate transcriptional activity.

Xu et al. (2015) assessed the DNA sequence features that contribute to single guide RNA (sgRNA) efficiency in CRISPR-based screens. The authors explored efficiency of CRISPR/Cas9 knockout and nucleotide preference at the cleavage site. The authors also found that the sequence preference for CRISPRi/a is substantially different from that for CRISPR/Cas9 knockout.

Parnas et al. (2015) introduced genome-wide pooled CRISPR-Cas9 libraries into dendritic cells (DCs) to identify genes that control the induction of tumor necrosis factor (Tnf) by bacterial lipopolysaccharide (LPS). Known regulators of Tlr4 signaling and previously unknown candidates were identified and classified into three functional modules with distinct effects on the canonical responses to LPS.

Ramanan et al (2015) demonstrated cleavage of viral episomal DNA (cccDNA) in infected cells. The HBV genome exists in the nuclei of infected hepatocytes as a 3.2 kb double-stranded episomal DNA species called covalently closed circular DNA (cccDNA), which is a key component in the HBV life cycle whose replication is not inhibited by current therapies. The authors showed that sgRNAs specifically targeting highly conserved regions of HBV robustly suppresses viral replication and depleted cccDNA.

Nishimasu et al. (2015) reported the crystal structures of SaCas9 in complex with a single guide RNA (sgRNA) and its double-stranded DNA targets, containing the 5'-TTGAAT-3' PAM and the 5'-TTGGGT-3' PAM. A structural comparison of SaCas9 with SpCas9 highlighted both structural conservation and divergence, explaining their distinct PAM specificities and orthologous sgRNA recognition.

Also, "Dimeric CRISPR RNA-guided FokI nucleases for highly specific genome editing", Shengdar Q. Tsai, Nicolas Wyvekens, Cyd Khayter, Jennifer A. Foden, Vishal Thapar, Deepak Reyon, Mathew J. Goodwin, Martin J. Aryee, J. Keith Joung Nature Biotechnology 32(6): 569-77 (2014), relates to dimeric RNA-guided FokI Nucleases that recognize extended sequences and can edit endogenous genes with high efficiencies in human cells. In addition, mention is made of PCT application PCT/US14/70057, and BI-2013/107 entitled "DELIVERY, USE AND THERAPEUTIC APPLICATIONS OF THE CRISPR-CAS SYSTEMS AND COMPOSITIONS FOR TARGETING DISORDERS AND DISEASES USING PARTICLE DELIVERY COMPONENTS (claiming priority from one or more or all of U.S. provisional patent application 62/054,490, filed Sep. 24, 2014; 62/010,441, filed Jun. 10, 2014; and 61/915,118, 61/915,215 and 61/915,148, each filed on Dec. 12, 2013) ("the Particle Delivery PCT"), incorporated herein by reference, with respect to a method of preparing an sgRNA-and-Cas9 protein containing particle comprising admixing a mixture comprising an sgRNA and Cas9 protein (and optionally HDR template) with a mixture comprising or consisting essentially of or consisting of surfactant, phospholipid, biodegradable polymer, lipoprotein and alcohol; and particles from such a process. For example, wherein Cas9 protein and sgRNA were mixed together at a suitable, e.g., 3:1 to 1:3 or 2:1 to 1:2 or 1:1 molar ratio, at a suitable temperature, e.g., 15-30C, e.g., 20-25C, e.g., room temperature, for a suitable time, e.g., 15-45, such as 30 minutes, advantageously in sterile, nuclease free buffer, e.g., 1×PBS. Separately, particle components such as or comprising: a surfactant, e.g., cationic lipid, e.g., 1,2-dioleoyl-3-trimethylammonium-propane (DOTAP); phospholipid, e.g., dimyristoylphosphatidylcholine (DMPC); biodegradable polymer, such as an ethylene-glycol polymer or PEG, and a lipoprotein, such as a low-density lipoprotein, e.g., cholesterol were dissolved in an alcohol, advantageously a $C_{1-6}$ alkyl alcohol, such as methanol, ethanol, isopropanol, e.g., 100% ethanol. The two solutions were mixed together to form particles containing the Cas9-sgRNA complexes. Accordingly, sgRNA may be pre-complexed with the Cas9 protein, before formulating the entire complex in a particle. Formulations may be made with a different molar ratio of different components known to promote delivery of nucleic acids into cells (e.g. 1,2-dioleoyl-3-trimethylammonium-propane (DOTAP), 1,2-ditetradecanoyl-sn-glycero-3-phosphocholine (DMPC), polyethylene glycol (PEG), and cholesterol) For example DOTAP:DMPC:PEG:Cholesterol Molar Ratios may be DOTAP 100, DMPC 0, PEG 0, Cholesterol 0; or DOTAP 90, DMPC 0, PEG 10, Cholesterol 0; or DOTAP 90, DMPC 0, PEG 5, Cholesterol 5. DOTAP 100, DMPC 0, PEG 0, Cholesterol 0. That application accordingly comprehends admixing sgRNA, Cas9 protein and components that form a particle; as well as particles from such admixing. Aspects of the instant invention can involve particles; for example, particles using a process analogous to that of the Particle Delivery PCT, e.g., by admixing a mixture comprising crRNA and/or CRISPR-Cas as in the instant invention and components that form a particle, e.g., as in the Particle Delivery PCT, to form a particle and particles from such admixing (or, of course, other particles involving crRNA and/or CRISPR-Cas as in the instant invention).

Guide Sequences

In embodiments of the invention the terms guide sequence and guide RNA and crRNA are used interchangeably as in foregoing cited documents such as WO 2014/093622 (PCT/US2013/074667). In general, a guide sequence is any polynucleotide sequence having sufficient complementarity with a target polynucleotide sequence to hybridize with the target sequence and direct sequence-specific binding of a CRISPR complex to the target sequence. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g., the Burrows Wheeler Aligner), ClustalW, Clustal X, BLAT, Novoalign (Novocraft Technologies; available at www.novocraft.com), ELAND (Illumina, San Diego, CA), SOAP (available at soap.genomics.org.cn), and Maq (available at maq.sourceforge.net). In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20, 15, 12, or fewer nucleotides in length. Preferably the guide sequence is 10-30 nucleotides long, such as 30 nucleotides long. The ability of a guide sequence to direct sequence-specific binding of a CRISPR complex to a target sequence may be assessed by any suitable assay. For example, the components of a CRISPR system sufficient to form a CRISPR complex, including the guide sequence to be tested, may be provided to a host cell having the corresponding target sequence, such as by transfection with vectors encoding the components of the CRISPR sequence, followed by an assessment of preferential cleavage within the target sequence, such as by Surveyor assay as described herein. Similarly, cleavage of a target polynucleotide sequence may be evaluated in a test tube by providing the target sequence, components of a CRISPR complex, including the guide sequence to be tested and a control guide sequence different from the test guide sequence, and comparing binding or rate of cleavage at the target sequence between the test and control guide sequence reactions. Other assays are possible, and will occur to those skilled in the art. A guide sequence may be selected to target any target sequence. In some embodiments, the target sequence is a sequence within a genome of a cell. Exemplary target sequences include those that are unique in the target genome.

In general, and throughout this specification, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g., circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g., retroviruses, replication defective retroviruses, adenoviruses, replication defective adenoviruses, and adeno-associated viruses). Viral vectors also include polynucleotides carried by a virus for transfection into a host cell. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Vectors for and that result in expression in a eukaryotic cell can be referred to herein as "eukaryotic expression vectors." Common expression vectors of utility in recombinant DNA techniques are often in the form of plasmids.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g., in an in vitro transcription/translation system or in a host cell when the vector is introduced into the host cell).

The term "regulatory element" is intended to include promoters, enhancers, internal ribosomal entry sites (IRES), and other expression control elements (e.g., transcription termination signals, such as polyadenylation signals and poly-U sequences). Such regulatory elements are described, for example, in Goeddel, GENE EXPRESSION TECHNOLOGY: METHODS IN ENZYMOLOGY 185, Academic Press, San Diego, Calif. (1990). Regulatory elements include those that direct constitutive expression of a nucleotide sequence in many types of host cell and those that direct expression of the nucleotide sequence only in certain host cells (e.g., tissue-specific regulatory sequences). A tissue-specific promoter may direct expression primarily in a desired tissue of interest, such as muscle, neuron, bone, skin, blood, specific organs (e.g., liver, pancreas), or particular cell types (e.g., lymphocytes). Regulatory elements may also direct expression in a temporal-dependent manner, such as in a cell-cycle dependent or developmental stage-dependent manner, which may or may not also be tissue or cell-type specific. In some embodiments, a vector comprises one or more pol III promoter (e.g., 1, 2, 3, 4, 5, or more pol III promoters), one or more pol II promoters (e.g., 1, 2, 3, 4, 5, or more pol II promoters), one or more pol I promoters (e.g., 1, 2, 3, 4, 5, or more pol I promoters), or combinations thereof. Examples of pol III promoters include, but are not limited to, U6 and H1 promoters. Examples of pol II promoters include, but are not limited to, the retroviral Rous sarcoma virus (RSV) LTR promoter (optionally with the RSV enhancer), the cytomegalovirus (CMV) promoter (optionally with the CMV enhancer) [see, e.g., Boshart et al, Cell, 41:521-530 (1985)], the SV40 promoter, the dihydrofolate reductase promoter, the β-actin promoter, the phosphoglycerol kinase (PGK) promoter, and the EF1α promoter. Also encompassed by the term "regulatory element" are enhancer elements, such as WPRE; CMV enhancers; the R-U5' segment in LTR of HTLV-I (Mol. Cell. Biol., Vol. 8(1), p. 466-472, 1988); SV40 enhancer; and the intron sequence between exons 2 and 3 of rabbit β-globin (Proc. Natl. Acad. Sci. USA., Vol. 78(3), p. 1527-31, 1981). It will be appreciated by those skilled in the art that the design of the expression vector can depend on such factors as the choice of the host cell to be transformed, the level of expression desired, etc. A vector can be introduced into host cells to thereby produce transcripts, proteins, or peptides, including fusion proteins or peptides, encoded by nucleic acids as described herein (e.g., clustered regularly interspersed short palindromic repeats (CRISPR) transcripts, proteins, enzymes, mutant forms thereof, fusion proteins thereof, etc.).

Advantageous vectors include lentiviruses and adeno-associated viruses, and types of such vectors can also be selected for targeting particular types of cells.

As used herein, the term “crRNA” or “guide RNA” or “single guide RNA” or “sgRNA” or “one or more nucleic acid components” of a Type VI CRISPR-Cas locus effector protein comprises any polynucleotide sequence having sufficient complementarity with a target nucleic acid sequence to hybridize with the target nucleic acid sequence and direct sequence-specific binding of a RNA-targeting complex to the target RNA sequence.

In certain embodiments, the CRISPR system as provided herein can make use of a crRNA or analogous polynucleotide comprising a guide sequence, wherein the polynucleotide is an RNA, a DNA or a mixture of RNA and DNA, and/or wherein the polynucleotide comprises one or more nucleotide analogs. The sequence can comprise any structure, including but not limited to a structure of a native crRNA, such as a bulge, a hairpin or a stem loop structure. In certain embodiments, the polynucleotide comprising the guide sequence forms a duplex with a second polynucleotide sequence which can be an RNA or a DNA sequence.

In certain embodiments, guides of the invention comprise non-naturally occurring nucleic acids and/or non-naturally occurring nucleotides and/or nucleotide analogs, and/or chemically modifications. Non-naturally occurring nucleic acids can include, for example, mixtures of naturally and non-naturally occurring nucleotides. Non-naturally occurring nucleotides and/or nucleotide analogs may be modified at the ribose, phosphate, and/or base moiety. In an embodiment of the invention, a guide nucleic acid comprises ribonucleotides and non-ribonucleotides. In one such embodiment, a guide comprises one or more ribonucleotides and one or more deoxyribonucleotides. In an embodiment of the invention, the guide comprises one or more non-naturally occurring nucleotide or nucleotide analog such as a nucleotide with phosphorothioate linkage, boranophosphate linkage, a locked nucleic acid (LNA) nucleotides comprising a methylene bridge between the 2' and 4' carbons of the ribose ring, or bridged nucleic acids (BNA). Other examples of modified nucleotides include 2'-O-methyl analogs, 2'-deoxy analogs, 2-thiouridine analogs, N6-methyladenosine analogs, or 2'-fluoro analogs. Further examples of modified bases include, but are not limited to, 2-aminopurine, 5-bromo-uridine, pseudouridine (Ψ), N1-methylpseudouridine (me1Ψ), 5-methoxyuridine (5moU), inosine, 7-methylguanosine. Examples of guide RNA chemical modifications include, without limitation, incorporation of 2'-O-methyl (M), 2'-O-methyl 3'phosphorothioate (MS), S-constrained ethyl (cEt), or 2'-O-methyl 3'thioPACE (MSP) at one or more terminal nucleotides. Such chemically modified guide RNAs can comprise increased stability and increased activity as compared to unmodified guide RNAs, though on-target vs. off-target specificity is not predictable. (See, Hendel, 2015, Nat Biotechnol. 33(9):985-9, doi: 10.1038/nbt.3290, published online 29 Jun. 2015; Allerson et al., J. Med. Chem. 2005, 48:901-904; Bramsen et al., Front. Genet., 2012, 3:154; Deng et al., PNAS, 2015, 112:11870-11875; Sharma et al., MedChemComm., 2014, 5:1454-1471; Li et al., Nature Biomedical Engineering, 2017, 1, 0066 DOI:10.1038/s41551-017-0066).

In some embodiments, the 5' and/or 3' end of a guide RNA is modified by a variety of functional moieties including fluorescent dyes, polyethylene glycol, cholesterol, proteins, or detection tags. (See Kelly et al., 2016, J. Biotech. 233:74-83). In certain embodiments, a guide comprises ribonucleotides in a region that binds to a target DNA and one or more deoxyribonucleotides and/or nucleotide analogs in a region that binds to Cas9, Cpf1, or C2c1. In an embodiment of the invention, deoxyribonucleotides and/or nucleotide analogs are incorporated in engineered guide structures, such as, without limitation, 5' and/or 3' end, stem-loop regions, and the seed region. In certain embodiments, the modification is not in the 5'-handle of the stem-loop regions. Chemical modification in the 5'-handle of the stem-loop region of a guide may abolish its function (see Li, et al., Nature Biomedical Engineering, 2017, 1:0066). In certain embodiments, at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, or 75 nucleotides of a guide is chemically modified. In some embodiments, 3-5 nucleotides at either the 3' or the 5' end of a guide is chemically modified. In some embodiments, only minor modifications are introduced in the seed region, such as 2'-F modifications. In some embodiments, 2'-F modification is introduced at the 3' end of a guide. In certain embodiments, three to five nucleotides at the 5' and/or the 3' end of the guide are chemically modified with 2'-O-methyl (M), 2'-O-methyl-3'-phosphorothioate (MS), S-constrained ethyl(cEt), or 2'-O-methyl-3'-thioPACE (MSP). Such modification can enhance genome editing efficiency (see Hendel et al., Nat. Biotechnol. (2015) 33(9): 985-989). In certain embodiments, all of the phosphodiester bonds of a guide are substituted with phosphorothioates (PS) for enhancing levels of gene disruption. In certain embodiments, more than five nucleotides at the 5' and/or the 3' end of the guide are chemically modified with 2'-O-Me, 2'-F or S-constrained ethyl(cEt). Such chemically modified guide can mediate enhanced levels of gene disruption (see Ragdarm et al., 0215, PNAS, E7110-E7111). In an embodiment of the invention, a guide is modified to comprise a chemical moiety at its 3' and/or 5' end. Such moieties include, but are not limited to amine, azide, alkyne, thio, dibenzocyclooctyne (DBCO), or Rhodamine. In certain embodiment, the chemical moiety is conjugated to the guide by a linker, such as an alkyl chain. In certain embodiments, the chemical moiety of the modified guide can be used to attach the guide to another molecule, such as DNA, RNA, protein, or nanoparticles. Such chemically modified guide can be used to identify or enrich cells generically edited by a CRISPR system (see Lee et al., eLife, 2017, 6:e25312, DOI:10.7554)

In some embodiments, the modification to the guide is a chemical modification, an insertion, a deletion or a split. In some embodiments, the chemical modification includes, but is not limited to, incorporation of 2'-O-methyl (M) analogs, 2'-deoxy analogs, 2-thiouridine analogs, N6-methyladenosine analogs, 2'-fluoro analogs, 2-aminopurine, 5-bromo-uridine, pseudouridine (Ψ), N1-methylpseudouridine (me1Ψ), 5-methoxyuridine (5moU), inosine, 7-methylguanosine, 2'-O-methyl-3'-phosphorothioate (MS), S-constrained ethyl(cEt), phosphorothioate (PS), or 2'-O-methyl-3'-thioPACE (MSP). In some embodiments, the guide comprises one or more of phosphorothioate modifications. In certain embodiments, at least 1, 2, 3, 4, 5, 6, 7, 8, 9, 10, 11, 12, 13, 14, 15, 16, 17, 18, 19, 20, or 25 nucleotides of the guide are chemically modified. In certain embodiments, one or more nucleotides in the seed region are chemically modified. In certain embodiments, one or more nucleotides in the 3'-terminus are chemically modified. In certain embodiments, none of the nucleotides in the 5'-handle is chemically modified. In some embodiments, the chemical modification in the seed region is a minor modification, such as incorporation of a 2'-fluoro analog. In a specific embodiment, one nucleotide of the seed region is replaced with a 2'-fluoro analog. In some embodiments, 5 or 10 nucleotides in the 3'-terminus are chemically modified. Such chemical modifications at the 3'-terminus of the Cpf1 CrRNA improve gene cutting efficiency (see Li, et al., Nature Biomedical Engineering, 2017, 1:0066). In a specific embodiment, 5 nucleotides in the 3'-terminus are replaced with 2'-fluoro analogues. In a specific embodiment, 10 nucleotides in the 3'-terminus are replaced with 2'-fluoro analogues. In a specific embodiment, 5 nucleotides in the 3'-terminus are replaced with 2'-O-methyl (M) analogs.

In some embodiments, the loop of the 5'-handle of the guide is modified. In some embodiments, the loop of the 5'-handle of the guide is modified to have a deletion, an insertion, a split, or chemical modifications. In certain embodiments, the loop comprises 3, 4, or 5 nucleotides. In certain embodiments, the loop comprises the sequence of UCUU, UUUU, UAUU, or UGUU.

In one aspect, the guide comprises portions that are chemically linked or conjugated via a non-phosphodiester bond. In one aspect, the guide comprises, in non-limiting examples, direct repeat sequence portion and a targeting sequence portion that are chemically linked or conjugated via a non-nucleotide loop. In some embodiments, the portions are joined via a non-phosphodiester covalent linker. Examples of the covalent linker include but are not limited to a chemical moiety selected from the group consisting of carbamates, ethers, esters, amides, imines, amidines, aminotrizines, hydrozone, disulfides, thioethers, thioesters, phosphorothioates, phosphorodithioates, sulfonamides, sulfonates, fulfones, sulfoxides, ureas, thioureas, hydrazide, oxime, triazole, photolabile linkages, C—C bond forming groups such as Diels-Alder cyclo-addition pairs or ring-closing metathesis pairs, and Michael reaction pairs.

In some embodiments, portions of the guide are first synthesized using the standard phosphoramidite synthetic protocol (Herdewijn, P., ed., Methods in Molecular Biology Col 288, Oligonucleotide Synthesis: Methods and Applications, Humana Press, New Jersey (2012)). In some embodiments, the non-targeting guide portions can be functionalized to contain an appropriate functional group for ligation using the standard protocol known in the art (Hermanson, G. T., Bioconjugate Techniques, Academic Press (2013)). Examples of functional groups include, but are not limited to, hydroxyl, amine, carboxylic acid, carboxylic acid halide, carboxylic acid active ester, aldehyde, carbonyl, chlorocarbonyl, imidazolylcarbonyl, hydrozide, semicarbazide, thio semicarbazide, thiol, maleimide, haloalkyl, sufonyl, ally, propargyl, diene, alkyne, and azide. Once a non-targeting portions of a guide is functionalized, a covalent chemical bond or linkage can be formed between the two oligonucleotides. Examples of chemical bonds include, but are not limited to, those based on carbamates, ethers, esters, amides, imines, amidines, aminotrizines, hydrozone, disulfides, thioethers, thioesters, phosphorothioates, phosphorodithioates, sulfonamides, sulfonates, fulfones, sulfoxides, ureas, thioureas, hydrazide, oxime, triazole, photolabile linkages, C—C bond forming groups such as Diels-Alder cyclo-addition pairs or ring-closing metathesis pairs, and Michael reaction pairs.

In some embodiments, one or more portions of a guide can be chemically synthesized. In some embodiments, the chemical synthesis uses automated, solid-phase oligonucleotide synthesis machines with 2'-acetoxyethyl orthoester (2'-ACE) (Scaringe et al., J. Am. Chem. Soc. (1998) 120: 11820-11821; Scaringe, Methods Enzymol. (2000) 317: 3-18) or 2'-thionocarbamate (2'-TC) chemistry (Dellinger et al., J. Am. Chem. Soc. (2011) 133: 11540-11546; Hendel et al., Nat. Biotechnol. (2015) 33:985-989).

In some embodiments, the guide portions can be covalently linked using various bioconjugation reactions, loops, bridges, and non-nucleotide links via modifications of sugar, internucleotide phosphodiester bonds, purine and pyrimidine residues. Sletten et al., Angew. Chem. Int. Ed. (2009) 48:6974-6998; Manoharan, M. Curr. Opin. Chem. Biol. (2004) 8: 570-9; Behlke et al., Oligonucleotides (2008) 18: 305-19; Watts, et al., Drug. Discov. Today (2008) 13: 842-55; Shukla, et al., ChemMedChem (2010) 5: 328-49.

In some embodiments, the guide portions can be covalently linked using click chemistry. In some embodiments, guide portions can be covalently linked using a triazole linker. In some embodiments, guide portions can be covalently linked using Huisgen 1,3-dipolar cycloaddition reaction involving an alkyne and azide to yield a highly stable triazole linker (He et al., ChemBioChem (2015) 17: 1809-1812; WO 2016/186745). In some embodiments, guide portions are covalently linked by ligating a 5'-hexyne portion and a 3'-azide portion. In some embodiments, either or both of the 5'-hexyne guide portion and a 3'-azide guide portion can be protected with 2'-acetoxyethl orthoester (2'-ACE) group, which can be subsequently removed using Dharmacon protocol (Scaringe et al., J. Am. Chem. Soc. (1998) 120: 11820-11821; Scaringe, Methods Enzymol. (2000) 317: 3-18).

In some embodiments, guide portions can be covalently linked via a linker (e.g., a non-nucleotide loop) that comprises a moiety such as spacers, attachments, bioconjugates, chromophores, reporter groups, dye labeled RNAs, and non-naturally occurring nucleotide analogues. More specifically, suitable spacers for purposes of this invention include, but are not limited to, polyethers (e.g., polyethylene glycols, polyalcohols, polypropylene glycol or mixtures of ethylene and propylene glycols), polyamines group (e.g., spennine, spermidine and polymeric derivatives thereof), polyesters (e.g., poly(ethyl acrylate)), polyphosphodiesters, alkylenes, and combinations thereof. Suitable attachments include any moiety that can be added to the linker to add additional properties to the linker, such as but not limited to, fluorescent labels. Suitable bioconjugates include, but are not limited to, peptides, glycosides, lipids, cholesterol, phospholipids, diacyl glycerols and dialkyl glycerols, fatty acids, hydrocarbons, enzyme substrates, steroids, biotin, digoxigenin, carbohydrates, polysaccharides. Suitable chromophores, reporter groups, and dye-labeled RNAs include, but are not limited to, fluorescent dyes such as fluorescein and rhodamine, chemiluminescent, electrochemiluminescent, and bioluminescent marker compounds. The design of example linkers conjugating two RNA components are also described in WO 2004/015075.

The linker (e.g., a non-nucleotide loop) can be of any length. In some embodiments, the linker has a length equivalent to about 0-16 nucleotides. In some embodiments, the linker has a length equivalent to about 0-8 nucleotides. In some embodiments, the linker has a length equivalent to about 0-4 nucleotides. In some embodiments, the linker has a length equivalent to about 2 nucleotides. Example linker design is also described in WO2011/008730.

In some embodiments, the degree of complementarity, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g., the Burrows Wheeler Aligner), ClustalW, Clustal X, BLAT, Novoalign (Novocraft Technologies; available at www.novocraft.com), ELAND (Illumina, San Diego, CA), SOAP (available at soap.genomics.org.cn), and Maq (available at maq.sourceforge.net). The ability of a guide sequence (within a RNA-targeting guide RNA or crRNA) to direct sequence-specific binding of a nucleic acid-targeting complex to a target nucleic acid sequence may be assessed by any suitable assay. For example, the components of a RNA-targeting CRISPR-Cas system sufficient to form a nucleic acid-targeting complex, including the guide sequence to be tested, may be provided to a host cell having the corresponding target nucleic acid sequence, such as by transfection with vectors encoding the components of the nucleic acid-targeting complex, followed by an assessment of preferential targeting (e.g., cleavage) within the target nucleic acid sequence, such as by Surveyor assay as described herein. Similarly, cleavage of a target nucleic acid sequence may be evaluated in a test tube by providing the target nucleic acid sequence, components of a nucleic acid-targeting complex, including the guide sequence to be tested and a control guide sequence different from the test guide sequence, and comparing binding or rate of cleavage at the target sequence between the test and control guide sequence reactions. Other assays are possible, and will occur to those skilled in the art. A guide sequence, and hence a RNA-targeting guide RNA or crRNA may be selected to target any target nucleic acid sequence. The target sequence may be DNA. The target sequence may be any RNA sequence. In some embodiments, the target sequence may be a sequence within a RNA molecule selected from the group consisting of messenger RNA (mRNA), pre-mRNA, ribosomal RNA (rRNA), transfer RNA (tRNA), micro-RNA (miRNA), small interfering RNA (siRNA), small nuclear RNA (snRNA), small nucleolar RNA (snoRNA), double stranded RNA (dsRNA), non-coding RNA (ncRNA), long non-coding RNA (lncRNA), and small cytoplasmatic RNA (scRNA). In some preferred embodiments, the target sequence may be a sequence within a RNA molecule selected from the group consisting of mRNA, pre-mRNA, and rRNA. In some preferred embodiments, the target sequence may be a sequence within a RNA molecule selected from the group consisting of ncRNA, and lncRNA. In some more preferred embodiments, the target sequence may be a sequence within an mRNA molecule or a pre-mRNA molecule.

In some embodiments, a RNA-targeting guide RNA or crRNA is selected to reduce the degree secondary structure within the RNA-targeting guide RNA or crRNA. In some embodiments, about or less than about 75%, 50%, 40%, 30%, 25%, 20%, 15%, 10%, 5%, 1%, or fewer of the nucleotides of the RNA-targeting guide RNA participate in self-complementary base pairing when optimally folded. Optimal folding may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g., A. R. Gruber et al., 2008, Cell 106(1): 23-24; and PA Carr and GM Church, 2009, Nature Biotechnology 27(12): 1151-62).

In some embodiments, a nucleic acid-targeting guide is designed or selected to modulate intermolecular interactions among guide molecules, such as among stem-loop regions of different guide molecules. It will be appreciated that nucleotides within a guide that base-pair to form a stem-loop are also capable of base-pairing to form an intermolecular duplex with a second guide and that such an intermolecular duplex would not have a secondary structure compatible with CRISPR complex formation. Accordingly, is useful to select or design DR sequences in order to modulate stem-loop formation and CRISPR complex formation. In some embodiments, about or less than about 75%, 50%, 40%, 30%, 25%, 20%, 15%, 10%, 5%, 1%, or fewer of nucleic acid-targeting guides are in intermolecular duplexes. It will be appreciated that stem-loop variation will often be within limits imposed by DR-CRISPR effector interactions. One way to modulate stem-loop formation or change the equilibrium between stem-loop and intermolecular duplex is to vary nucleotide pairs in the stem of the stem-loop of a DR. For example, in one embodiment, a G-C pair is replaced by an A-U or U-A pair. In another embodiment, an A-U pair is substituted for a G-C or a C-G pair. In another embodiment, a naturally occurring nucleotide is replaced by a nucleotide analog. Another way to modulate stem-loop formation or change the equilibrium between stem-loop and intermolecular duplex is to modify the loop of the stem-loop of a DR. Without be bound by theory, the loop can be viewed as an intervening sequence flanked by two sequences that are complementary to each other. When that intervening sequence is not self-complementary, its effect will be to destabilize intermolecular duplex formation. The same principle applies when guides are multiplexed: while the targeting sequences may differ, it may be advantageous to modify the stem-loop region in the DRs of the different guides. Moreover, when guides are multiplexed, the relative activities of the different guides can be modulated by balancing the activity of each individual guide. In certain embodiments, the equilibrium between intermolecular stem-loops vs. intermolecular duplexes is determined. The determination may be made by physical or biochemical means and can be in the presence or absence of a CRISPR effector.

In certain embodiments, a guide RNA or crRNA may comprise, consist essentially of, or consist of a direct repeat (DR) sequence and a guide sequence or spacer sequence. In certain embodiments, the guide RNA or crRNA may comprise, consist essentially of, or consist of a direct repeat sequence fused or linked to a guide sequence or spacer sequence. In certain embodiments, the direct repeat sequence may be located upstream (i.e., 5') from the guide sequence or spacer sequence. In other embodiments, the direct repeat sequence may be located downstream (i.e., 3') from the guide sequence or spacer sequence. In other embodiments, multiple DRs (such as dual DRs) may be present.

In certain embodiments, the crRNA comprises a stem loop, preferably a single stem loop. In certain embodiments, the direct repeat sequence forms a stem loop, preferably a single stem loop.

In certain embodiments, the spacer length of the guide RNA is from 15 to 35 nt. In certain embodiments, the spacer length of the guide RNA is at least 15 nucleotides. In certain embodiments, the spacer length is from 15 to 17 nt, e.g., 15, 16, or 17 nt, from 17 to 20 nt, e.g., 17, 18, 19, or 20 nt, from 20 to 24 nt, e.g., 20, 21, 22, 23, or 24 nt, from 23 to 25 nt, e.g., 23, 24, or 25 nt, from 24 to 27 nt, e.g., 24, 25, 26, or 27 nt, from 27-30 nt, e.g., 27, 28, 29, or 30 nt, from 30-35 nt, e.g., 30, 31, 32, 33, 34, or 35 nt, or 35 nt or longer.

The "tracrRNA" sequence or analogous terms includes any polynucleotide sequence that has sufficient complementarity with a crRNA sequence to hybridize. In general, degree of complementarity is with reference to the optimal alignment of the sca sequence and tracr sequence, along the length of the shorter of the two sequences. Optimal alignment may be determined by any suitable alignment algorithm, and may further account for secondary structures, such as self-complementarity within either the sca sequence or tracr sequence. In some embodiments, the degree of complementarity between the tracr sequence and sca sequence along the length of the shorter of the two when optimally aligned is about or more than about 25%, 30%, 40%, 50%, 60%, 70%, 80%, 90%, 95%, 97.5%, 99%, or higher. In certain embodiments, the tracrRNA may not be required. Indeed, the CRISPR-Cas effector protein from *Bergeyella zoohelcum* and orthologs thereof do not require a tracrRNA to ensure cleavage of an RNA target.

In further detail, the assay is as follows for a RNA target, provided that a PAM sequence is required to direct recognition. Two *E. coli* strains are used in this assay. One carries a plasmid that encodes the endogenous effector protein locus from the bacterial strain. The other strain carries an empty plasmid (e.g. pACYC184, control strain). All possible 7 or 8 bp PAM sequences are presented on an antibiotic resistance plasmid (pUC19 with ampicillin resistance gene). The PAM is located next to the sequence of proto-spacer 1 (the RNA target to the first spacer in the endogenous effector protein locus). Two PAM libraries were cloned. One has a 8 random bp 5' of the proto-spacer (e.g. total of 65536 different PAM sequences=complexity). The other library has 7 random bp 3' of the proto-spacer (e.g. total complexity is 16384 different PAMs). Both libraries were cloned to have in average 500 plasmids per possible PAM. Test strain and control strain were transformed with 5'PAM and 3'PAM library in separate transformations and transformed cells were plated separately on ampicillin plates. Recognition and subsequent cutting/interference with the plasmid renders a cell vulnerable to ampicillin and prevents growth. Approximately 12 h after transformation, all colonies formed by the test and control strains where harvested and plasmid RNA was isolated. Plasmid RNA was used as template for PCR amplification and subsequent deep sequencing. Representation of all PAMs in the untransformed libraries showed the expected representation of PAMs in transformed cells. Representation of all PAMs found in control strains showed the actual representation. Representation of all PAMs in test strain showed which PAMs are not recognized by the enzyme and comparison to the control strain allows extracting the sequence of the depleted PAM. In particular embodiments, the cleavage, such as the RNA cleavage is not PAM dependent. Indeed, for the *Bergeyella zoohelcum* Cas13b effector protein and its orthologs, RNA target cleavage appears to be PAM independent, and hence the Table 1 Cas13b of the invention may act in a PAM independent fashion.

For minimization of toxicity and off-target effect, it will be important to control the concentration of RNA-targeting guide RNA delivered. Optimal concentrations of nucleic acid-targeting guide RNA can be determined by testing different concentrations in a cellular or non-human eukaryote animal model and using deep sequencing the analyze the extent of modification at potential off-target genomic loci. The concentration that gives the highest level of on-target modification while minimizing the level of off-target modification should be chosen for in vivo delivery. The RNA-targeting system is derived advantageously from a CRISPR-Cas system. In some embodiments, one or more elements of a RNA-targeting system is derived from a particular organism comprising an endogenous RNA-targeting system of a Tables 1-4 Cas13 effector protein system as herein-discussed.

Dead Guide Sequence

In one aspect, the invention provides guide sequences which are modified in a manner which allows for formation of the CRISPR Cas complex and successful binding to the target, while at the same time, not either allowing for or not allowing for successful nuclease activity (i.e. without nuclease activity/without indel activity). For matters of explanation such modified guide sequences are referred to as “dead guides” or “dead guide sequences”. These dead guides or dead guide sequences can be thought of as catalytically inactive or conformationally inactive with regard to nuclease activity. Indeed, dead guide sequences may not sufficiently engage in productive base pairing with respect to the ability to promote catalytic activity or to distinguish on-target and off-target binding activity. Briefly, the assay involves synthesizing a CRISPR target RNA and guide RNAs comprising mismatches with the target RNA, combining these with the RNA targeting enzyme and analyzing cleavage based on gels based on the presence of bands generated by cleavage products, and quantifying cleavage based upon relative band intensities.

Hence, in a related aspect, the invention provides a non-naturally occurring or engineered composition RNA targeting CRISPR-Cas system comprising a functional RNA targeting enzyme as described herein, and guide RNA (gRNA) or crRNA wherein the gRNA or crRNA comprises a dead guide sequence whereby the gRNA is capable of hybridizing to a target sequence such that the RNA targeting CRISPR-Cas system is directed to a genomic locus of interest in a cell without detectable RNA cleavage activity of a non-mutant RNA targeting enzyme of the system. It is to be understood that any of the gRNAs or crRNAs according to the invention as described herein elsewhere may be used as dead gRNAs/crRNAs comprising a dead guide sequence.

The ability of a dead guide sequence to direct sequence-specific binding of a CRISPR complex to an RNA target sequence may be assessed by any suitable assay. For example, the components of a CRISPR-Cas system sufficient to form a CRISPR-Cas complex, including the dead guide sequence to be tested, may be provided to a host cell having the corresponding target sequence, such as by transfection with vectors encoding the components of the system, followed by an assessment of preferential cleavage within the target sequence.

As explained further herein, several structural parameters allow for a proper framework to arrive at such dead guides. Dead guide sequences can be typically shorter than respective guide sequences which result in active RNA cleavage. In particular embodiments, dead guides are 5%, 10%, 20%, 30%, 40%, 50%, shorter than respective guides directed to the same.

As explained below and known in the art, one aspect of gRNA or crRNA-RNA targeting specificity is the direct repeat sequence, which is to be appropriately linked to such guides. In particular, this implies that the direct repeat sequences are designed dependent on the origin of the RNA targeting enzyme. Structural data available for validated dead guide sequences may be used for designing CRISPR-Cas specific equivalents. Structural similarity between, e.g., the orthologous nuclease domains HEPN of two or more CRISPR-Cas effector proteins may be used to transfer design equivalent dead guides. Thus, the dead guide herein may be appropriately modified in length and sequence to reflect such CRISPR-Cas specific equivalents, allowing for formation of the CRISPR-Cas complex and successful binding to the target RNA, while at the same time, not allowing for successful nuclease activity.

Dead guides allow one to use gRNA or crRNA as a means for gene targeting, without the consequence of nuclease activity, while at the same time providing directed means for activation or repression. Guide RNA or crRNA comprising a dead guide may be modified to further include elements in a manner which allow for activation or repression of gene activity, in particular protein adaptors (e.g. aptamers) as described herein elsewhere allowing for functional placement of gene effectors (e.g. activators or repressors of gene activity). One example is the incorporation of aptamers, as explained herein and in the state of the art. By engineering the gRNA or crRNA comprising a dead guide to incorporate protein-interacting aptamers (Konermann et al., "Genome-scale transcription activation by an engineered CRISPR-Cas9 complex," doi:10.1038/nature14136, incorporated herein by reference), one may assemble multiple distinct effector domains. Such may be modeled after natural processes.

Cas13 in General

The instant invention provides particular Cas13 effectors, nucleic acids, systems, vectors, and methods of use. The features and functions of Cas13 may also be the features and functions of other CRISPR-Cas proteins described herein.

As used herein, the terms Cas13b-s1 accessory protein, Cas13b-s1 protein, Cas13b-s1, Csx27, and Csx27 protein are used interchangeably and the terms Cas13b-s2 accessory protein, Cas13b-s2 protein, Cas13b-S2, Csx28, and Csx28 protein are used interchangeably.

In particular embodiments, the wildtype Cas13 effector protein has RNA binding and cleaving function.

In particular embodiments, the (wild type or mutated) Cas13 effector protein may have RNA and/or DNA cleaving function, preferably RNA cleaving function. In these embodiments, methods may be provided based on the effector proteins provided herein which comprehend inducing one or more mutations in a eukaryotic cell (in vitro, i.e. in an isolated eukaryotic cell) as herein discussed comprising delivering to cell a vector as herein discussed. The mutation(s) can include the introduction, deletion, or substitution of one or more nucleotides at each target sequence of cell(s) via the guide(s) RNA(s) or sgRNA(s) or crRNA(s). The mutations can include the introduction, deletion, or substitution of 1-75 nucleotides at each target sequence of said cell(s) via the guide(s) RNA(s) or sgRNA(s) or crRNA(s). The mutations can include the introduction, deletion, or substitution of 1, 5, 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s) or sgRNA(s) or crRNA(s). The mutations can include the introduction, deletion, or substitution of 5, 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s) or sgRNA(s) or crRNA(s). The mutations include the introduction, deletion, or substitution of 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s) or sgRNA(s) or crRNA(s). The mutations can include the introduction, deletion, or substitution of 20, 21, 22, 23, 24, 25, 26, 27, 28, 29, 30, 35, 40, 45, 50, or 75 nucleotides at each target sequence of said cell(s) via the guide(s) RNA(s) or sgRNA(s) or crRNA(s). The mutations can include the introduction, deletion, or substitution of 40, 45, 50, 75, 100, 200, 300, 400 or 500 nucleotides at each target sequence of said cell(s) via the guide(s) RNA(s) or sgRNA(s) or crRNAs.

For minimization of toxicity and off-target effect, it will be important to control the concentration of Cas13 mRNA and guide RNA delivered. Optimal concentrations of Cas13 mRNA and guide RNA can be determined by testing different concentrations in a cellular or non-human eukaryote animal model and using deep sequencing the analyze the extent of modification at potential off-target genomic loci. Guide sequences and strategies to minimize toxicity and off-target effects can be as in WO 2014/093622 (PCT/US2013/074667); or, via mutation as herein.

The nucleic acid molecule encoding a Cas13 is advantageously codon optimized. An example of a codon optimized sequence, is in this instance a sequence optimized for expression in a eukaryote, e.g., humans (i.e. being optimized for expression in humans), or for another eukaryote, animal or mammal as herein discussed; see, e.g., SaCas9 human codon optimized sequence in WO 2014/093622 (PCT/US2013/074667). Whilst this is preferred, it will be appreciated that other examples are possible and codon optimization for a host species other than human, or for codon optimization for specific organs is known. In some embodiments, an enzyme coding sequence encoding a Cas is codon optimized for expression in particular cells, such as eukaryotic cells. The eukaryotic cells may be those of or derived from a particular organism, such as a mammal, including but not limited to human, or non-human eukaryote or animal or mammal as herein discussed, e.g., mouse, rat, rabbit, dog, livestock, or non-human mammal or primate. In some embodiments, processes for modifying the germ line genetic identity of human beings and/or processes for modifying the genetic identity of animals which are likely to cause them suffering without any substantial medical benefit to man or animal, and also animals resulting from such processes, may be excluded. In general, codon optimization refers to a process of modifying a nucleic acid sequence for enhanced expression in the host cells of interest by replacing at least one codon (e.g. about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at www.kazusa.orjp/codon/ and these tables can be adapted in a number of ways. See Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, PA), are also available. In some embodiments, one or more codons (e.g. 1, 2, 3, 4, 5, 10, 15, 20, 25, 50, or more, or all codons) in a sequence encoding a Cas correspond to the most frequently used codon for a particular amino acid.

In some embodiments, the unmodified RNA-targeting effector protein (Cas13) may have cleavage activity. In some embodiments, Cas13 may direct cleavage of one or two nucleic acid strands at the location of or near a target sequence, such as within the target sequence and/or within the complement of the target sequence or at sequences associated with the target sequence, e.g., within about 1, 2, 3, 4, 5, 6, 7, 8, 9, 10, 15, 20, 25, 50, 100, 200, 500, or more base pairs from the first or last nucleotide of a target sequence. In some embodiments, the Cas13 protein may direct more than one cleavage (such as one, two three, four, five, or more cleavages) of one or two strands within the target sequence and/or within the complement of the target sequence or at sequences associated with the target sequence and/or within about 1, 2, 3, 4, 5, 6, 7, 8, 9, 10, 15, 20, 25, 50, 100, 200, 500, or more base pairs from the first or last nucleotide of a target sequence. In some embodiments, the cleavage may be blunt, i.e., generating blunt ends. In some embodiments, the cleavage may be staggered, i.e., generating sticky ends. In some embodiments, a vector encodes a nucleic acid-targeting Cas13 protein that may be mutated with respect to a corresponding wild-type enzyme such that the mutated nucleic acid-targeting Cas13 protein lacks the ability to cleave one or two strands of a target polynucleotide containing a target sequence, e.g., alteration or mutation in a HEPN domain to produce a mutated Cas13 substantially lacking all RNA cleavage activity, e.g., the RNA cleavage activity of the mutated enzyme is about no more than 25%, 10%, 5%, 1%, 0.1%, 0.01%, or less of the nucleic acid cleavage activity of the non-mutated form of the enzyme; an example can be when the nucleic acid cleavage activity of the mutated form is nil or negligible as compared with the non-mutated form. By derived, Applicants mean that the derived enzyme is largely based, in the sense of having a high degree of sequence homology with, a wildtype enzyme, but that it has been mutated (modified) in some way as known in the art or as described herein.

Typically, in the context of an endogenous RNA-targeting system, formation of a RNA-targeting complex (comprising a guide RNA or crRNA hybridized to a target sequence and complexed with one or more RNA-targeting effector proteins) results in cleavage of RNA strand(s) in or near (e.g., within 1, 2, 3, 4, 5, 6, 7, 8, 9, 10, 20, 50, or more base pairs from) the target sequence. As used herein the term "sequence(s) associated with a target locus of interest" refers to sequences near the vicinity of the target sequence (e.g. within 1, 2, 3, 4, 5, 6, 7, 8, 9, 10, 20, 50, or more base pairs from the target sequence, wherein the target sequence is comprised within a target locus of interest).

An example of a codon optimized sequence, is in this instance a sequence optimized for expression in a eukaryote, e.g., humans (i.e. being optimized for expression in humans), or for another eukaryote, animal or mammal as herein discussed; see, e.g., SaCas9 human codon optimized sequence in WO 2014/093622 (PCT/US2013/074667) as an example of a codon optimized sequence (from knowledge in the art and this disclosure, codon optimizing coding nucleic acid molecule(s), especially as to effector protein (e.g., Cas13) is within the ambit of the skilled artisan). Whilst this is preferred, it will be appreciated that other examples are possible and codon optimization for a host species other than human, or for codon optimization for specific organs is known. In some embodiments, an enzyme coding sequence encoding a RNA-targeting Cas13 protein is codon optimized for expression in particular cells, such as eukaryotic cells. The eukaryotic cells may be those of or derived from a particular organism, such as a mammal, including but not limited to human, or non-human eukaryote or animal or mammal as herein discussed, e.g., mouse, rat, rabbit, dog, livestock, or non-human mammal or primate. In some embodiments, processes for modifying the germ line genetic identity of human beings and/or processes for modifying the genetic identity of animals which are likely to cause them suffering without any substantial medical benefit to man or animal, and also animals resulting from such processes, may be excluded. In general, codon optimization refers to a process of modifying a nucleic acid sequence for enhanced expression in the host cells of interest by replacing at least one codon (e.g., about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at www.kazusa.orjp/codon/ and these tables can be adapted in a number of ways. See Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, PA), are also available. In some embodiments, one or more codons (e.g., 1, 2, 3, 4, 5, 10, 15, 20, 25, 50, or more, or all codons) in a sequence encoding a DNA/RNA-targeting Cas protein corresponds to the most frequently used codon for a particular amino acid.

The (i) Cas13 or nucleic acid molecule(s) encoding it or (ii) crRNA can be delivered separately; and advantageously at least one or both of one of (i) and (ii), e.g., an assembled complex is delivered via a particle or nanoparticle complex. RNA-targeting effector protein mRNA can be delivered prior to the RNA-targeting guide RNA or crRNA to give time for nucleic acid-targeting effector protein to be expressed. RNA-targeting effector protein (Cas13) mRNA might be administered 1-12 hours (preferably around 2-6 hours) prior to the administration of RNA-targeting guide RNA or crRNA. Alternatively, RNA-targeting effector protein mRNA and RNA-targeting guide RNA or crRNA can be administered together. Advantageously, a second booster dose of guide RNA or crRNA can be administered 1-12 hours (preferably around 2-6 hours) after the initial administration of RNA-targeting effector (Cas13) protein mRNA+guide RNA. Additional administrations of RNA-targeting effector protein mRNA and/or guide RNA or crRNA might be useful to achieve the most efficient levels of genome modification.

In one aspect, the invention provides methods for using one or more elements of a RNA-targeting system. The RNA-targeting complex of the invention provides an effective means for modifying a target RNA single or double stranded, linear or super-coiled. The RNA-targeting complex of the invention has a wide variety of utility including modifying (e.g., deleting, inserting, translocating, inactivating, activating) a target RNA in a multiplicity of cell types. As such the RNA-targeting complex of the invention has a broad spectrum of applications in, e.g., gene therapy, drug screening, disease diagnosis, and prognosis. An exemplary RNA-targeting complex comprises a RNA-targeting effector protein complexed with a guide RNA or crRNA hybridized to a target sequence within the target locus of interest.

In one embodiment, this invention provides a method of cleaving a target RNA. The method may comprise modifying a target RNA using a RNA-targeting complex that binds to the target RNA and effect cleavage of said target RNA. In an embodiment, the RNA-targeting complex of the invention, when introduced into a cell, may create a break (e.g., a single or a double strand break) in the RNA sequence. For example, the method can be used to cleave a disease RNA in a cell. For example, an exogenous RNA template comprising a sequence to be integrated flanked by an upstream sequence and a downstream sequence may be introduced into a cell. The upstream and downstream sequences share sequence similarity with either side of the site of integration in the RNA. Where desired, a donor RNA can be mRNA. The exogenous RNA template comprises a sequence to be integrated (e.g., a mutated RNA). The sequence for integration may be a sequence endogenous or exogenous to the cell. Examples of a sequence to be integrated include RNA encoding a protein or a non-coding RNA (e.g., a microRNA). Thus, the sequence for integration may be operably linked to an appropriate control sequence or sequences. Alternatively, the sequence to be integrated may provide a regulatory function. The upstream and downstream sequences in the exogenous RNA template are selected to promote recombination between the RNA sequence of interest and the donor RNA. The upstream sequence is a RNA sequence that shares sequence similarity with the RNA sequence upstream of the targeted site for integration. Similarly, the downstream sequence is a RNA sequence that shares sequence similarity with the RNA sequence downstream of the targeted site of integration. The upstream and downstream sequences in the exogenous RNA template can have 75%, 80%, 85%, 90%, 95%, or 100% sequence identity with the targeted RNA sequence. Preferably, the upstream and downstream sequences in the exogenous RNA template have about 95%, 96%, 97%, 98%, 99%, or 100% sequence identity with the targeted RNA sequence. In some methods, the upstream and downstream sequences in the exogenous RNA template have about 99% or 100% sequence identity with the targeted RNA sequence. An upstream or downstream sequence may comprise from about 20 bp to about 2500 bp, for example, about 50, 100, 200, 300, 400, 500, 600, 700, 800, 900, 1000, 1100, 1200, 1300, 1400, 1500, 1600, 1700, 1800, 1900, 2000, 2100, 2200, 2300, 2400, or 2500 bp. In some methods, the exemplary upstream or downstream sequence have about 200 bp to about 2000 bp, about 600 bp to about 1000 bp, or more particularly about 700 bp to about 1000 bp. In some methods, the exogenous RNA template may further comprise a marker. Such a marker may make it easy to screen for targeted integrations. Examples of suitable markers include restriction sites, fluorescent proteins, or selectable markers. The exogenous RNA template of the invention can be constructed using recombinant techniques (see, for example, Sambrook et al., 2001 and Ausubel et al., 1996). In a method for modifying a target RNA by integrating an exogenous RNA template, a break (e.g., double or single stranded break in double or single stranded RNA) is introduced into the RNA sequence by the nucleic acid-targeting complex, the break is repaired via homologous recombination with an exogenous RNA template such that the template is integrated into the RNA target. The presence of a double-stranded break facilitates integration of the template. In other embodiments, this invention provides a method of modifying expression of a RNA in a eukaryotic cell. The method comprises increasing or decreasing expression of a target polynucleotide by using a nucleic acid-targeting complex that binds to the DNA or RNA (e.g., mRNA or pre-mRNA). In some methods, a target RNA can be inactivated to affect the modification of the expression in a cell. For example, upon the binding of a RNA-targeting complex to a target sequence in a cell, the target RNA is inactivated such that the sequence is not translated, the coded protein is not produced, or the sequence does not function as the wild-type sequence does. For example, a protein or microRNA coding sequence may be inactivated such that the protein or microRNA or pre-microRNA transcript is not produced. The target RNA of a RNA-targeting complex can be any RNA endogenous or exogenous to the eukaryotic cell. For example, the target RNA can be a RNA residing in the nucleus of the eukaryotic cell. The target RNA can be a sequence (e.g., mRNA or pre-mRNA) coding a gene product (e.g., a protein) or a non-coding sequence (e.g., ncRNA, lncRNA, tRNA, or rRNA). Examples of target RNA include a sequence associated with a signaling biochemical pathway, e.g., a signaling biochemical pathway-associated RNA. Examples of target RNA include a disease associated RNA. A "disease-associated" RNA refers to any RNA which is yielding translation products at an abnormal level or in an abnormal form in cells derived from a disease-affected tissues compared with tissues or cells of a non disease control. It may be a RNA transcribed from a gene that becomes expressed at an abnormally high level; it may be a RNA transcribed from a gene that becomes expressed at an abnormally low level, where the altered expression correlates with the occurrence and/or progression of the disease. A disease-associated RNA also refers to a RNA transcribed from a gene possessing mutation(s) or genetic variation that is directly responsible or is in linkage disequilibrium with a gene(s) that is responsible for the etiology of a disease. The translated products may be known or unknown, and may be at a normal or abnormal level. The target RNA of a RNA-targeting complex can be any RNA endogenous or exogenous to the eukaryotic cell. For example, the target RNA can be a RNA residing in the nucleus of the eukaryotic cell. The target RNA can be a sequence (e.g., mRNA or pre-mRNA) coding a gene product (e.g., a protein) or a non-coding sequence (e.g., ncRNA, lncRNA, tRNA, or rRNA).

In some embodiments, the method may comprise allowing a RNA-targeting complex to bind to the target RNA to effect cleavage of said target RNA thereby modifying the target RNA, wherein the RNA-targeting complex comprises a nucleic acid-targeting effector (Cas13) protein complexed with a guide RNA or crRNA hybridized to a target sequence within said target RNA. In one aspect, the invention provides a method of modifying expression of RNA in a eukaryotic cell. In some embodiments, the method comprises allowing a RNA-targeting complex to bind to the RNA such that said binding results in increased or decreased expression of said RNA; wherein the RNA-targeting complex comprises a nucleic acid-targeting effector (Cas13) protein complexed with a guide RNA. Methods of modifying a target RNA can be in a eukaryotic cell, which may be in vivo, ex vivo or in vitro. In some embodiments, the method comprises sampling a cell or population of cells from a human or non-human animal, and modifying the cell or cells. Culturing may occur at any stage ex vivo. The cell or cells may even be re-introduced into the non-human animal or plant. For re-introduced cells it is particularly preferred that the cells are stem cells.

The use of two different aptamers (each associated with a distinct RNA-targeting guide RNAs) allows an activator-adaptor protein fusion and a repressor-adaptor protein fusion to be used, with different RNA-targeting guide RNAs or crRNAs, to activate expression of RNA, whilst repressing another. They, along with their different guide RNAs or crRNAs can be administered together, or substantially together, in a multiplexed approach. A large number of such modified RNA-targeting guide RNAs or crRNAs can be used all at the same time, for example 10 or 20 or 30 and so forth, whilst only one (or at least a minimal number) of effector protein (Cas13) molecules need to be delivered, as a comparatively small number of effector protein molecules can be used with a large number of modified guides. The adaptor protein may be associated (preferably linked or fused to) one or more activators or one or more repressors. For example, the adaptor protein may be associated with a first activator and a second activator. The first and second activators may be the same, but they are preferably different activators. Three or more or even four or more activators (or repressors) may be used, but package size may limit the number being higher than 5 different functional domains. Linkers are preferably used, over a direct fusion to the adaptor protein, where two or more functional domains are associated with the adaptor protein. Suitable linkers might include the GlySer linker.

It is also envisaged that the RNA-targeting effector protein-guide RNA complex as a whole may be associated with two or more functional domains. For example, there may be two or more functional domains associated with the RNA-targeting effector protein, or there may be two or more functional domains associated with the guide RNA or crRNA (via one or more adaptor proteins), or there may be one or more functional domains associated with the RNA-targeting effector protein and one or more functional domains associated with the guide RNA or crRNA (via one or more adaptor proteins).

The fusion between the adaptor protein and the activator or repressor may include a linker. For example, GlySer linkers GGGS can be used. They can be used in repeats of 3 ($(GGGGS)_3$ (SEQ ID NO:79)) or 6, 9 or even 12 or more, to provide suitable lengths, as required. Linkers can be used between the guide RNAs and the functional domain (activator or repressor), or between the nucleic acid-targeting effector protein and the functional domain (activator or repressor). The linkers the user to engineer appropriate amounts of "mechanical flexibility".

CRISPR effector (Cas13) protein or mRNA therefor (or more generally a nucleic acid molecule therefor) and guide RNA or crRNA might also be delivered separately e.g., the former 1-12 hours (preferably around 2-6 hours) prior to the administration of guide RNA or crRNA, or together. A second booster dose of guide RNA or crRNA can be administered 1-12 hours (preferably around 2-6 hours) after the initial administration.

The Cas13 effector protein is sometimes referred to herein as a CRISPR Enzyme. It will be appreciated that the effector protein is based on or derived from an enzyme, so the term 'effector protein' certainly includes 'enzyme' in some embodiments. However, it will also be appreciated that the effector protein may, as required in some embodiments, have DNA or RNA binding, but not necessarily cutting or nicking, activity, including a dead-Cas effector protein function.

Cellular targets include Hemopoietic Stem/Progenitor Cells (CD34+); Human T cells; and Eye (retinal cells)—for example photoreceptor precursor cells.

Inventive methods can further comprise delivery of templates. Delivery of templates may be via the cotemporaneous or separate from delivery of any or all the CRISPR effector protein (Cas13) or guide or crRNA and via the same delivery mechanism or different.

In certain embodiments, the methods as described herein may comprise providing a Cas13 transgenic cell in which one or more nucleic acids encoding one or more guide RNAs are provided or introduced operably connected in the cell with a regulatory element comprising a promoter of one or more gene of interest. As used herein, the term "Cas13 transgenic cell" refers to a cell, such as a eukaryotic cell, in which a Cas13 gene has been genomically integrated. The nature, type, or origin of the cell are not particularly limiting according to the present invention. Also the way how the Cas13 transgene is introduced in the cell is may vary and can be any method as is known in the art. In certain embodiments, the Cas13 transgenic cell is obtained by introducing the Cas13 transgene in an isolated cell. In certain other embodiments, the Cas13 transgenic cell is obtained by isolating cells from a Cas13 transgenic organism. By means of example, and without limitation, the Cas13 transgenic cell as referred to herein may be derived from a Cas13 transgenic eukaryote, such as a Cas13 knock-in eukaryote. Reference is made to WO 2014/093622 (PCT/US13/74667), incorporated herein by reference. Methods of US Patent Publication Nos. 20120017290 and 20110265198 assigned to Sangamo BioSciences, Inc. directed to targeting the Rosa locus may be modified to utilize the CRISPR Cas system of the present invention. Methods of US Patent Publication No. 20130236946 assigned to Cellectis directed to targeting the Rosa locus may also be modified to utilize the CRISPR Cas system of the present invention. By means of further example reference is made to Platt et. al. (Cell; 159(2):440-455 (2014)), describing a Cas9 knock-in mouse, which is incorporated herein by reference. The Cas13 transgene can further comprise a Lox-Stop-polyA-Lox (LSL) cassette thereby rendering Cas13 expression inducible by Cre recombinase. Alternatively, the Cas13 transgenic cell may be obtained by introducing the Cas13 transgene in an isolated cell. Delivery systems for transgenes are well known in the art. By means of example, the Cas13 transgene may be delivered in for instance eukaryotic cell by means of vector (e.g., AAV, adenovirus, lentivirus) and/or particle and/or particle delivery, as also described herein elsewhere.

It will be understood by the skilled person that the cell, such as the Cas13 transgenic cell, as referred to herein may comprise further genomic alterations besides having an integrated Cas13 gene or the mutations arising from the sequence specific action of Cas13 when complexed with RNA capable of guiding Cas13 to a target locus, such as for instance one or more oncogenic mutations, as for instance and without limitation described in Platt et al. (2014), Chen et al., (2014) or Kumar et al., (2009).

In some embodiments, the Cas13 sequence is fused to one or more nuclear localization sequences (NLSs), such as about or more than about 1, 2, 3, 4, 5, 6, 7, 8, 9, 10, or more NLSs. In some embodiments, the Cas13 comprises about or more than about 1, 2, 3, 4, 5, 6, 7, 8, 9, 10, or more NLSs at or near the amino-terminus, about or more than about 1, 2, 3, 4, 5, 6, 7, 8, 9, 10, or more NLSs at or near the carboxy-terminus, or a combination of these (e.g. zero or at least one or more NLS at the amino-terminus and zero or at one or more NLS at the carboxy terminus). When more than one NLS is present, each may be selected independently of the others, such that a single NLS may be present in more than one copy and/or in combination with one or more other NLSs present in one or more copies. In a preferred embodiment of the invention, the Cas13 comprises at most 6 NLSs. In some embodiments, an NLS is considered near the N- or C-terminus when the nearest amino acid of the NLS is within about 1, 2, 3, 4, 5, 10, 15, 20, 25, 30, 40, 50, or more amino acids along the polypeptide chain from the N- or C-terminus. Non-limiting examples of NLSs include an NLS sequence derived from: the NLS of the SV40 virus large T-antigen, having the amino acid sequence PKKKRKV (SEQ ID NO: 80); the NLS from nucleoplasmin (e.g. the nucleoplasmin bipartite NLS with the sequence KRPAATKKAGQAKKKK) (SEQ ID NO: 81); the c-myc NLS having the amino acid sequence PAAKRVKLD (SEQ ID NO: 82) or RQRRNELKRSP (SEQ ID NO: 83); the hRNPA1 M9 NLS having the sequence NQSSNFGPMKGGNFGGRSSGPYGGGGQYFAK-PRNQGGY (SEQ ID NO: 84); the sequence RMRIZFKNKGKDTAELRRRRVEVSVELRKAKKD-EQILKRRNV (SEQ ID NO: 85) of the IBB domain from importin-alpha; the sequences VSRKRPRP (SEQ ID NO: 86) and PPKKARED (SEQ ID NO: 87) of the myoma T protein; the sequence POPKKKPL (SEQ ID NO: 88) of human p53; the sequence SALIKKKKKMAP (SEQ ID NO: 89) of mouse c-abl IV; the sequences DRLRR (SEQ ID NO: 90) and PKQKKRK (SEQ ID NO: 91) of the influenza virus NS1; the sequence RKLKKKIKKL (SEQ ID NO: 92) of the Hepatitis virus delta antigen; the sequence REKKKFLKRR (SEQ ID NO: 93) of the mouse Mx1 protein; the sequence KRKGDEVDGVDEVAKKKSKK (SEQ ID NO: 94) of the human poly(ADP-ribose) polymerase; and the sequence RKCLQAGMNLEARKTKK (SEQ ID NO: 95) of the steroid hormone receptors (human) glucocorticoid. In general, the one or more NLSs are of sufficient strength to drive accumulation of the Cas in a detectable amount in the nucleus of a eukaryotic cell. In general, strength of nuclear localization activity may derive from the number of NLSs in the Cas, the particular NLS(s) used, or a combination of these factors. Detection of accumulation in the nucleus may be performed by any suitable technique. For example, a detectable marker may be fused to the Cas, such that location within a cell may be visualized, such as in combination with a means for detecting the location of the nucleus (e.g. a stain specific for the nucleus such as DAPI). Cell nuclei may also be isolated from cells, the contents of which may then be analyzed by any suitable process for detecting protein, such as immunohistochemistry, Western blot, or enzyme activity assay. Accumulation in the nucleus may also be determined indirectly, such as by an assay for the effect of CRISPR complex formation (e.g. assay for DNA cleavage or mutation at the target sequence, or assay for altered gene expression activity affected by CRISPR complex formation and/or Cas enzyme activity), as compared to a control no exposed to the Cas or complex, or exposed to a Cas lacking the one or more NLSs.

The guide RNA(s), e.g., sgRNA(s) or crRNA(s) encoding sequences and/or Cas13 encoding sequences, can be functionally or operatively linked to regulatory element(s) and hence the regulatory element(s) drive expression. The promoter(s) can be constitutive promoter(s) and/or conditional promoter(s) and/or inducible promoter(s) and/or tissue specific promoter(s). The promoter can be selected from the group consisting of RNA polymerases, pol I, pol II, pol III, T7, U6, H1, retroviral Rous sarcoma virus (RSV) LTR promoter, the cytomegalovirus (CMV) promoter, the SV40 promoter, the dihydrofolate reductase promoter, the β-actin promoter, the phosphoglycerol kinase (PGK) promoter, and the EF1α promoter. An advantageous promoter is the promoter is U6.

In some embodiments, a CRISPR effector (Cas 13n) protein may form a component of an inducible system. The inducible nature of the system would allow for spatiotemporal control of gene editing or gene expression using a form of energy. The form of energy may include but is not limited to electromagnetic radiation, sound energy, chemical energy and thermal energy. Examples of inducible system include tetracycline inducible promoters (Tet-On or Tet-Off), small molecule two-hybrid transcription activations systems (FKBP, ABA, etc.), or light inducible systems (Phytochrome, LOV domains, or cryptochrome). In one embodiment, the CRISPR effector protein may be a part of a Light Inducible Transcriptional Effector (LITE) to direct changes in transcriptional activity in a sequence-specific manner. The components of a light may include a CRISPR effector protein, a light-responsive cytochrome heterodimer (e.g. from *Arabidopsis thaliana*), and a transcriptional activation/repression domain. Further examples of inducible DNA binding proteins and methods for their use are provided in U.S. 61/736,465 and U.S. 61/721,283, and WO 2014018423 A2 which is hereby incorporated by reference in its entirety.

Whenever reference is made herein to Cas13, it will be understood that a mutated Cas13 according to the invention as described herein is meant, unless explicitly indicated otherwise. Whenever reference is made herein to Cas13, preferably a mutated Cas13a, Cas13b, Cas13c, or Cas13d according to the invention as described herein is meant, unless explicitly indicated otherwise. Whenever reference is made herein to Cas13, preferably a mutated Cas13b according to the invention as described herein is meant, unless explicitly indicated otherwise.

In one aspect, the invention provides a mutated Cas13 as described herein, such as preferably, but without limitation Cas13b as described herein elsewhere, having one or more mutations resulting in reduced off-target effects, i.e. improved CRISPR enzymes for use in effecting modifications to target loci but which reduce or eliminate activity towards off-targets, such as when complexed to guide RNAs, as well as improved CRISPR enzymes for increasing the activity of CRISPR enzymes, such as when complexed with guide RNAs. It is to be understood that mutated enzymes as described herein below may be used in any of the methods according to the invention as described herein elsewhere. Any of the methods, products, compositions and uses as described herein elsewhere are equally applicable with the mutated CRISPR enzymes as further detailed below.

Slaymaker et al. recently described a method for the generation of Cas9 orthologues with enhanced specificity (Slaymaker et al. 2015 "Rationally engineered Cas9 nucleases with improved specificity"). This strategy can be used to enhance the specificity of the Cas13 protein. Primary residues for mutagenesis are preferably all positive charges residues within the HEPN domain. Additional residues are positive charged residues that are conserved between different orthologues.

In an aspect, the invention also provides methods and mutations for modulating Cas13 binding activity and/or binding specificity. In certain embodiments Cas13 proteins lacking nuclease activity are used. In certain embodiments, modified guide RNAs are employed that promote binding but not nuclease activity of a Cas13 nuclease. In such embodiments, on-target binding can be increased or decreased. Also, in such embodiments off-target binding can be increased or decreased. Moreover, there can be increased or decreased specificity as to on-target binding vs. off-target binding.

The methods and mutations which can be employed in various combinations to increase or decrease activity and/or specificity of on-target vs. off-target activity, or increase or decrease binding and/or specificity of on-target vs. off-target binding, can be used to compensate or enhance mutations or modifications made to promote other effects. Such mutations or modifications made to promote other effects in include mutations or modification to the Cas13 and or mutation or modification made to a guide RNA. The methods and mutations of the invention are used to modulate Cas13 nuclease activity and/or binding with chemically modified guide RNAs.

In an aspect, the invention provides methods and mutations for modulating binding and/or binding specificity of Cas13 proteins according to the invention as defined herein comprising functional domains such as nucleases, transcriptional activators, transcriptional repressors, and the like. For example, a Cas13 protein can be made nuclease-null, or having altered or reduced nuclease activity by introducing mutations such as for instance Cas13 mutations described herein elsewhere. Nuclease deficient Cas13 proteins are useful for RNA-guided target sequence dependent delivery of functional domains. The invention provides methods and mutations for modulating binding of Cas13 proteins. In one embodiment, the functional domain comprises VP64, providing an RNA-guided transcription factor. In another embodiment, the functional domain comprises Fok I, providing an RNA-guided nuclease activity. Mention is made of U.S. Pat. Pub. 2014/0356959, U.S. Pat. Pub. 2014/0342456, U.S. Pat. Pub. 2015/0031132, and Mali, P. et al., 2013, Science 339(6121):823-6, doi: 10.1126/science.1232033, published online 3 Jan. 2013 and through the teachings herein the invention comprehends methods and materials of these documents applied in conjunction with the teachings herein. In certain embodiments, on-target binding is increased. In certain embodiments, off-target binding is decreased. In certain embodiments, on-target binding is decreased. In certain embodiments, off-target binding is increased. Accordingly, the invention also provides for increasing or decreasing specificity of on-target binding vs. off-target binding of functionalized Cas13 binding proteins.

The use of Cas13 as an RNA-guided binding protein is not limited to nuclease-null Ca13. Cas13 enzymes comprising nuclease activity can also function as RNA-guided binding proteins when used with certain guide RNAs. For example short guide RNAs and guide RNAs comprising nucleotides mismatched to the target can promote RNA directed Cas13 binding to a target sequence with little or no target cleavage. (See, e.g., Dahlman, 2015, Nat Biotechnol. 33(11):1159-1161, doi: 10.1038/nbt.3390, published online 5 Oct. 2015). In an aspect, the invention provides methods and mutations for modulating binding of Cas13 proteins that comprise nuclease activity. In certain embodiments, on-target binding is increased. In certain embodiments, off-target binding is decreased. In certain embodiments, on-target binding is decreased. In certain embodiments, off-target binding is increased. In certain embodiments, there is increased or decreased specificity of on-target binding vs. off-target binding. In certain embodiments, nuclease activity of guide RNA-Cas13 enzyme is also modulated.

RNA-RNA duplex formation is important for cleavage activity and specificity throughout the target region, not only the seed region sequence closest to the PAM. Thus, truncated guide RNAs show reduced cleavage activity and specificity. In an aspect, the invention provides method and mutations for increasing activity and specificity of cleavage using altered guide RNAs.

In certain embodiments, the catalytic activity of the CRISPR-Cas protein (e.g., Cas13) of the invention is altered or modified. It is to be understood that mutated Cas13 has an altered or modified catalytic activity if the catalytic activity is different than the catalytic activity of the corresponding wild type CRISPR-Cas protein (e.g., unmutated CRISPR-Cas protein). Catalytic activity can be determined by means known in the art. By means of example, and without limitation, catalytic activity can be determined in vitro or in vivo by determination of indel percentage (for instance after a given time, or at a given dose). In certain embodiments, catalytic activity is increased. In certain embodiments, catalytic activity is increased by at least 5%, preferably at least 10%, more preferably at least 20%, such as at least 30%, at least 40%, at least 50%, at least 60%, at least 70%, at least 80%, at least 90%, or at least 100%. In certain embodiments, catalytic activity is decreased. In certain embodiments, catalytic activity is decreased by at least 5%, preferably at least 10%, more preferably at least 20%, such as at least 30%, at least 40%, at least 50%, at least 60%, at least 70%, at least 80%, at least 90%, or (substantially) 100%. The one or more mutations herein may inactivate the catalytic activity, which may substantially all catalytic activity, below detectable levels, or no measurable catalytic activity.

One or more characteristics of the engineered CRISPR-Cas protein may be different from a corresponding wiled type CRISPR-Cas protein. Examples of such characteristics include catalytic activity, gRNA binding, specificity of the CRISPR-Cas protein (e.g., specificity of editing a defined target), stability of the CRISPR-Cas protein, off-target binding, target binding, protease activity, nickase activity, PFS recognition. In some examples, a engineered CRISPR-Cas protein may comprise one or more mutations of the corresponding wild type CRISPR-Cas protein. In some embodiments, the catalytic activity of the engineered CRISPR-Cas protein is increased as compared to a corresponding wildtype CRISPR-Cas protein. In some embodiments, the catalytic activity of the engineered CRISPR-Cas protein is decreased as compared to a corresponding wildtype CRISPR-Cas protein. In some embodiments, the gRNA binding of the engineered CRISPR-Cas protein is increased as compared to a corresponding wildtype CRISPR-Cas protein. In some embodiments, the gRNA binding of the engineered CRISPR-Cas protein is decreased as compared to a corresponding wildtype CRISPR-Cas protein. In some embodiments, the specificity of the CRISPR-Cas protein is increased as compared to a corresponding wildtype CRISPR-Cas protein. In some embodiments, the specificity of the CRISPR-Cas protein is decreased as compared to a corresponding wildtype CRISPR-Cas protein. In some embodiments, the stability of the CRISPR-Cas protein is increased as compared to a corresponding wildtype CRISPR-Cas protein. In some embodiments, the stability of the CRISPR-Cas protein is decreased as compared to a corresponding wildtype CRISPR-Cas protein. In some embodiments, the engineered CRISPR-Cas protein further comprises one or more mutations which inactivate catalytic activity. In some embodiments, the off-target binding of the CRISPR-Cas protein is increased as compared to a corresponding wildtype CRISPR-Cas protein. In some embodiments, the off-target binding of the CRISPR-Cas protein is decreased as compared to a corresponding wildtype CRISPR-Cas protein. In some embodiments, the target binding of the CRISPR-Cas protein is increased as compared to a corresponding wildtype CRISPR-Cas protein. In some embodiments, the target binding of the CRISPR-Cas protein is decreased as compared to a corresponding wildtype CRISPR-Cas protein. In some embodiments, the engineered CRISPR-Cas protein has a higher protease activity or polynucleotide-binding capability compared with a corresponding wildtype CRISPR-Cas protein. In some embodiments, the PFS recognition is altered as compared to a corresponding wildtype CRISPR-Cas protein.

In certain embodiments, the gRNA (crRNA) binding of the Cas13 protein of the invention is altered or modified. It is to be understood that mutated Cas13 has an altered or modified gRNA binding if the gRNA binding is different than the gRNA binding of the corresponding wild type Cas13 (i.e. unmutated Cas13).gRNA binding can be determined by means known in the art. By means of example, and without limitation, gRNA binding can be determined by calculating binding strength or affinity (such as based on equilibrium constants, Ka, Kd, etc). In certain embodiments, gRNA binding is increased. In certain embodiments, gRNA binding is increased by at least 5%, preferably at least 10%, more preferably at least 20%, such as at least 30%, at least 40%, at least 50%, at least 60%, at least 70%, at least 80%, at least 90%, or at least 100%. In certain embodiments, gRNA binding is decreased. In certain embodiments, gRNA binding is decreased by at least 5%, preferably at least 10%, more preferably at least 20%, such as at least 30%, at least 40%, at least 50%, at least 60%, at least 70%, at least 80%, at least 90%, or (substantially) 100%.

In certain embodiments, the specificity of the Cas13 protein of the invention is altered or modified. It is to be understood that mutated Cas13 has an altered or modified specificity if the specificity is different than the specificity of the corresponding wild type Cas13 (i.e. unmutated Cas13). Specificity can be determined by means known in the art. By means of example, and without limitation, specificity can be determined by comparison of on-target activity and off-target activity. In certain embodiments, specificity is increased. In certain embodiments, specificity is increased by at least 5%, preferably at least 10%, more preferably at least 20%, such as at least 30%, at least 40%, at least 50%, at least 60%, at least 70%, at least 80%, at least 90%, or at least 100%. In certain embodiments, specificity is decreased. In certain embodiments, specificity is decreased by at least 5%, preferably at least 10%, more preferably at least 20%, such as at least 30%, at least 40%, at least 50%, at least 60%, at least 70%, at least 80%, at least 90%, or (substantially) 100%.

In certain embodiments, the stability of the Cas13 protein of the invention is altered or modified. It is to be understood that mutated Cas13 has an altered or modified stability if the stability is different than the stability of the corresponding wild type Cas13 (i.e. unmutated Cas13). Stability can be determined by means known in the art. By means of example, and without limitation, stability can be determined by determining the half-life of the Cas13 protein. In certain embodiments, stability is increased. In certain embodiments, stability is increased by at least 5%, preferably at least 10%, more preferably at least 20%, such as at least 30%, at least 40%, at least 50%, at least 60%, at least 70%, at least 80%, at least 90%, or at least 100%. In certain embodiments, stability is decreased. In certain embodiments, stability is decreased by at least 5%, preferably at least 10%, more preferably at least 20%, such as at least 30%, at least 40%, at least 50%, at least 60%, at least 70%, at least 80%, at least 90%, or (substantially) 100%.

In certain embodiments, the target binding of the Cas13 protein of the invention is altered or modified. It is to be understood that mutated Cas13 has an altered or modified target binding if the target binding is different than the target binding of the corresponding wild type Cas13 (i.e. unmutated Cas13). target binding can be determined by means known in the art. By means of example, and without limitation, target binding can be determined by calculating binding strength or affinity (such as based on equilibrium constants, Ka, Kd, etc). In certain embodiments, target bindings increased. In certain embodiments, target binding is increased by at least 5%, preferably at least 10%, more preferably at least 20%, such as at least 30%, at least 40%, at least 50%, at least 60%, at least 70%, at least 80%, at least 90%, or at least 100%. In certain embodiments, target binding is decreased. In certain embodiments, target binding is decreased by at least 5%, preferably at least 10%, more preferably at least 20%, such as at least 30%, at least 40%, at least 50%, at least 60%, at least 70%, at least 80%, at least 90%, or (substantially) 100%.

In certain embodiments, the off-target binding of the Cas13 protein of the invention is altered or modified. It is to be understood that mutated Cas13 has an altered or modified off-target binding if the off-target binding is different than the off-target binding of the corresponding wild type Cas13 (i.e. unmutated Cas13). Off-target binding can be determined by means known in the art. By means of example, and without limitation, off-target binding can be determined by calculating binding strength or affinity (such as based on equilibrium constants, Ka, Kd, etc). In certain embodiments, off-target bindings increased. In certain embodiments, off-target binding is increased by at least 5%, preferably at least 10%, more preferably at least 20%, such as at least 30%, at least 40%, at least 50%, at least 60%, at least 70%, at least 80%, at least 90%, or at least 100%. In certain embodiments, off-target binding is decreased. In certain embodiments, off-target binding is decreased by at least 5%, preferably at least 10%, more preferably at least 20%, such as at least 30%, at least 40%, at least 50%, at least 60%, at least 70%, at least 80%, at least 90%, or (substantially) 100%.

In certain embodiments, the PFS (or PAM) recognition or specificity of the Cas13 protein of the invention is altered or modified. It is to be understood that mutated Cas13 has an altered or modified PFS recognition or specificity if the PFS recognition or specificity is different than the PFS recognition or specificity of the corresponding wild type Cas13 (i.e. unmutated Cas13). PFS recognition or specificity can be determined by means known in the art. By means of example, and without limitation, PFS recognition or specificity can be determined by PFS (PAM) screens. In certain embodiments, at least one different PFS is recognized by the Cas13. In certain embodiments, at least one PFS is recognized by the mutated Cas13 which is not recognized by the corresponding wild type Cas13. In certain embodiments, at least one PFS is recognized by the mutated Cas13 which is not recognized by the corresponding wild type Cas13, in addition to the wild type PFS. In certain embodiments, at least one PFS is recognized by the mutated Cas13 which is not recognized by the corresponding wild type Cas13, and the wild type PFS is not anymore recognized. In certain embodiments, the PFS recognized by the mutated Cas13 is longer than the PFS recognized by the wild type Cas13, such as 1, 2, or 3 nucleotides longer. In certain embodiments, the PFS recognized by the mutated Cas13 is shorter than the PFS recognized by the wild type Cas13, such as 1, 2, or 3 nucleotides shorter.

The invention provides a non-naturally occurring or engineered composition comprising i) a mutated Cas13 effector protein, and ii) a crRNA, wherein the crRNA comprises a) a guide sequence that is capable of hybridizing to a target RNA sequence, and b) a direct repeat sequence, whereby there is formed a CRISPR complex comprising the Cas13 effector protein complexed with the guide sequence that is hybridized to the target RNA sequence. The complex can be formed in vitro or ex vivo and introduced into a cell or contacted with RNA; or can be formed in vivo.

In some embodiments, such as for Cas13b, a non-naturally occurring or engineered composition of the invention may comprise an accessory protein that enhances Type VI-B CRISPR-Cas effector protein activity.

In certain such embodiments, the accessory protein that enhances Cas13b effector protein activity is a csx28 protein. In such embodiments, the Type VI-B CRISPR-Cas effector protein and the Type VI-B CRISPR-Cas accessory protein may be from the same source or from a different source.

In some embodiments, a non-naturally occurring or engineered composition of the invention comprises an accessory protein that represses Cas13b effector protein activity.

In certain such embodiments, the accessory protein that represses Cas13b effector protein activity is a csx27 protein. In such embodiments, the Type VI-B CRISPR-Cas effector protein and the Type VI-B CRISPR-Cas accessory protein may be from the same source or from a different source. In certain embodiments of the invention, the Type VI-B CRISPR-Cas effector protein is from Table 1.

In some embodiments, a non-naturally occurring or engineered composition of the invention comprises two or more crRNAs.

In some embodiments, a non-naturally occurring or engineered composition of the invention comprises a guide sequence that hybridizes to a target RNA sequence in a prokaryotic cell.

In some embodiments, a non-naturally occurring or engineered composition of the invention comprises a guide sequence that hybridizes to a target RNA sequence in a eukaryotic cell.

In some embodiment, the Cas13 effector protein comprises one or more nuclear localization signals (NLSs).

In certain embodiments, the Cas13 effector protein of the invention is, or in, or comprises, or consists essentially of, or consists of, or involves or relates to such a protein derived from or as set forth in Tables 1-4, and comprising one or more mutation of the invention as described herein elsewhere.

In some embodiment of the non-naturally occurring or engineered composition of the invention, the Cas13 effector protein is associated with one or more functional domains. The association can be by direct linkage of the effector protein to the functional domain, or by association with the crRNA. In a non-limiting example, the crRNA comprises an added or inserted sequence that can be associated with a functional domain of interest, including, for example, an aptamer or a nucleotide that binds to a nucleic acid binding adapter protein. The functional domain may be a functional heterologous domain.

In certain non-limiting embodiments, a non-naturally occurring or engineered composition of the invention comprises a functional domain cleaves the target RNA sequence.

In certain non-limiting embodiments, the non-naturally occurring or engineered composition of the invention comprises a functional domain that modifies transcription or translation of the target RNA sequence.

In some embodiment of the composition of the invention, the Cas13 effector protein is associated with one or more functional domains; and the effector protein contains one or more mutations within an HEPN domain, whereby the complex can deliver an epigenetic modifier or a transcriptional or translational activation or repression signal. The complex can be formed in vitro or ex vivo and introduced into a cell or contacted with RNA; or can be formed in vivo.

In some embodiment of the non-naturally occurring or engineered composition of the invention, the Cas13b effector protein and the accessory protein are from the same organism.

In some embodiment of the non-naturally occurring or engineered composition of the invention, the Cas13b effector protein and the accessory protein are from different organisms.

The invention also provides a Type VI CRISPR-Cas vector system, which comprises one or more vectors comprising:

a first regulatory element operably linked to a nucleotide sequence encoding the Cas13 effector protein, and a second regulatory element operably linked to a nucleotide sequence encoding the crRNA.

In certain embodiments, the vector system of the invention further comprises a regulatory element operably linked to a nucleotide sequence of a Type VI-B CRISPR-Cas accessory protein.

When appropriate, the nucleotide sequence encoding the Type VI CRISPR-Cas effector protein (and/or optionally the nucleotide sequence encoding the Type VI-B CRISPR-Cas accessory protein) is codon optimized for expression in a eukaryotic cell.

In some embodiment of the vector system of the invention, the nucleotide sequences encoding the Cas13 effector protein (and optionally) the accessory protein are codon optimized for expression in a eukaryotic cell.

In some embodiment, the vector system of the invention comprises in a single vector.

In some embodiment of the vector system of the invention, the one or more vectors comprise viral vectors.

In some embodiment of the vector system of the invention, the one or more vectors comprise one or more retroviral, lentiviral, adenoviral, adeno-associated or herpes simplex viral vectors.

The invention provides a delivery system configured to deliver a Cas13 effector protein and one or more nucleic acid components of a non-naturally occurring or engineered composition comprising i) a mutated Cas13 effector protein according to the invention as described herein, and ii) a crRNA, wherein the crRNA comprises a) a guide sequence that hybridizes to a target RNA sequence in a cell, and b) a direct repeat sequence, wherein the Cas13 effector protein forms a complex with the crRNA, wherein the guide sequence directs sequence-specific binding to the target RNA sequence, whereby there is formed a CRISPR complex comprising the Cas13 effector protein complexed with the guide sequence that is hybridized to the target RNA sequence. The complex can be formed in vitro or ex vivo and introduced into a cell or contacted with RNA; or can be formed in vivo.

In some embodiment of the delivery system of the invention, the system comprises one or more vectors or one or more polynucleotide molecules, the one or more vectors or polynucleotide molecules comprising one or more polynucleotide molecules encoding the Cas13 effector protein and one or more nucleic acid components of the non-naturally occurring or engineered composition.

In some embodiment, the delivery system of the invention comprises a delivery vehicle comprising liposome(s), particle(s), exosome(s), microvesicle(s), a gene-gun or one or more viral vector(s).

In some embodiment, the non-naturally occurring or engineered composition of the invention is for use in a therapeutic method of treatment or in a research program.

In some embodiment, the non-naturally occurring or engineered vector system of the invention is for use in a therapeutic method of treatment or in a research program.

In some embodiment, the non-naturally occurring or engineered delivery system of the invention is for use in a therapeutic method of treatment or in a research program.

The invention provides a method of modifying expression of a target gene of interest, the method comprising contacting a target RNA with one or more non-naturally occurring or engineered compositions comprising i) a mutated Cas13 effector protein according to the invention as described herein, and ii) a crRNA, wherein the crRNA comprises a) a guide sequence that hybridizes to a target RNA sequence in a cell, and b) a direct repeat sequence, wherein the Cas13 effector protein forms a complex with the crRNA, wherein the guide sequence directs sequence-specific binding to the target RNA sequence in a cell, whereby there is formed a CRISPR complex comprising the Cas13 effector protein complexed with the guide sequence that is hybridized to the target RNA sequence, whereby expression of the target locus of interest is modified. The complex can be formed in vitro or ex vivo and introduced into a cell or contacted with RNA; or can be formed in vivo.

In some embodiment, the method of modifying expression of a target gene of interest further comprises contacting the target RNA with an accessory protein that enhances Cas13b effector protein activity.

In some embodiment of the method of modifying expression of a target gene of interest, the accessory protein that enhances Cas13b effector protein activity is a csx28 protein.

In some embodiment, the method of modifying expression of a target gene of interest further comprises contacting the target RNA with an accessory protein that represses Cas13b effector protein activity.

In some embodiment of the method of modifying expression of a target gene of interest, the accessory protein that represses Cas13b effector protein activity is a csx27 protein.

In some embodiment, the method of modifying expression of a target gene of interest comprises cleaving the target RNA.

In some embodiment, the method of modifying expression of a target gene of interest comprises increasing or decreasing expression of the target RNA.

In some embodiment of the method of modifying expression of a target gene of interest, the target gene is in a prokaryotic cell.

In some embodiment of the method of modifying expression of a target gene of interest, the target gene is in a eukaryotic cell.

The invention provides a cell comprising a modified target of interest, wherein the target of interest has been modified according to any of the method disclosed herein.

In some embodiment of the invention, the cell is a prokaryotic cell.

In some embodiment of the invention, the cell is a eukaryotic cell.

In some embodiment, modification of the target of interest in a cell results in:

a cell comprising altered expression of at least one gene product;

a cell comprising altered expression of at least one gene product, wherein the expression of the at least one gene product is increased; or a cell comprising altered expression of at least one gene product, wherein the expression of the at least one gene product is decreased.

In some embodiment, the cell is a mammalian cell or a human cell.

The invention provides a cell line of or comprising a cell disclosed herein or a cell modified by any of the methods disclosed herein, or progeny thereof.

The invention provides a multicellular organism comprising one or more cells disclosed herein or one or more cells modified according to any of the methods disclosed herein.

The invention provides a plant or animal model comprising one or more cells disclosed herein or one or more cells modified according to any of the methods disclosed herein.

The invention provides a gene product from a cell or the cell line or the organism or the plant or animal model disclosed herein.

In some embodiment, the amount of gene product expressed is greater than or less than the amount of gene product from a cell that does not have altered expression.

In certain embodiments, the Cas13 protein originates from a species of the genus *Alistipes, Anaerosalibacter, Bacteroides, Bacteroidetes, Bergeyella, Blautia, Butyrivibrio, Capnocytophaga, Carnobacterium, Chloroflexus, Chryseobacterium, Clostridium, Demequina, Eubacteriaceae, Eubacterium, Flavobacterium, Fusobacterium, Herbinix, Insolitispirillum, Lachnospiraceae, Leptotrichia, Listeria, Myroides, Paludibacter, Phaeodactylibacter, Porphyromonadaceae, Porphyromonas, Prevotella, Pseudobutyrivibrio, Psychroflexus, Reichenbachiella, Rhodobacter, Riemerella, Sinomicrobium, Thalassospira, Ruminococcus*. As used herein, when a Cas13 protein originates form a species, it may be the wild type Cas13 protein in the species, or a homolog of the wild type Cas13 protein in the species. The Cas13 protein that is a homolog of the wild type Cas13 protein in the species may comprise one or more variations (e.g., mutations, truncations, etc.) of the wild type Cas13 protein.

In certain embodiments, the Cas13 protein originates from *Leptotrichia shahii, Listeria seeligeri, Lachnospiraceae bacterium* (such as Lb MA2020, Lb NK4A179, Lb NK4A144), *Clostridium aminophilum* (such as Ca DSM 10710), *Carnobacterium gallinarum* (such as Cg DSM 4847), *Paludibacter propionicigenes* (such as Pp WB4), *Listeria weihenstephanensis* (such as Lw FSL R9-0317), *Listeriaceae bacterium* (such as Lb FSL M6-0635), *Leptotrichia wadei* (such as Lw F0279), *Rhodobacter capsulatus* (such as Rc SB 1003, Rc R121, Rc DE442), *Leptotrichia buccalis* (such as Lb C-1013-b), *Herbinix hemicellulosilytica, Eubacteriaceae bacterium* (such as Eb CHKCI004), *Blautia*. sp Marseille-P2398, *Leptotrichia* sp. oral taxon 879 str. F0557, *Chloroflexus aggregans, Demequina aurantiaca, Thalassospira* sp. TSL5-1, *Pseudobutyrivibrio* sp. OR37,

*Butyrivibrio* sp. YAB3001, *Leptotrichia* sp. Marseille-P3007, *Bacteroides ihuae, Porphyromonadaceae bacterium* (such as Pb KH3CP3RA), *Listeria riparia, Insolitispirillum peregrinum, Alistipes* sp. ZOR0009, *Bacteroides pyogenes* (such as Bp F0041), *Bacteroidetes bacterium* (such as Bb GWA2_31_9), *Bergeyella zoohelcum* (such as Bz ATCC 43767), *Capnocytophaga canimorsus, Capnocytophaga cynodegmi, Chryseobacterium carnipullorum, Chryseobacterium jejuense, Chryseobacterium ureilyticum, Flavobacterium branchiophilum, Flavobacterium columnare, Flavobacterium* sp. 316, *Myroides odoratimimus* (such as Mo CCUG 10230, Mo CCUG 12901, Mo CCUG 3837), *Paludibacter propionicigenes, Phaeodactylibacter xiamenensis, Porphyromonas gingivalis* (such as Pg F0185, Pg F0568, Pg JCVI SC001, Pg W4087, *Porphyromonas gulae, Porphyromonas* sp. COT-052 OH4946, *Prevotella aurantiaca, Prevotella buccae* (such as Pb ATCC 33574), *Prevotella falsenii, Prevotella intermedia* (such as Pi 17, Pi ZT), *Prevotella pallens* (such as Pp ATCC 700821), *Prevotella pleuritidis, Prevotella saccharolytica* (such as Ps F0055), *Prevotella* sp. MA2016, *Prevotella* sp. MSX73, *Prevotella* sp. P4-76, *Prevotella* sp. P5-119, *Prevotella* sp. P5-125, *Prevotella* sp. P5-60, *Psychroflexus torquis, Reichenbachiella agariperforans, Riemerella anatipestifer, Sinomicrobium oceani, Fusobacterium necrophorum* (such as Fn subsp. *funduliforme* ATCC 51357, Fn DJ-2, Fn BFTR-1, Fn subsp. *Funduliforme*), *Fusobacterium perfoetens* (such as Fp ATCC 29250), *Fusobacterium ulcerans* (such as Fu ATCC 49185), *Anaerosalibacter* sp. ND1, *Eubacterium siraeum, Ruminococcus flavefaciens* (such as Rfx XPD3002), or *Ruminococcus albus.*

In certain embodiments, the Cas13 is Cas13a and originates from a species of the genus *Bacteroides, Blautia, Butyrivibrio, Carnobacterium, Chloroflexus, Clostridium, Demequina, Eubacterium, Herbinix, Insolitispirillum, Lachnospiraceae, Leptotrichia, Listeria, Paludibacter, Porphyromonadaceae, Pseudobutyrivibrio, Rhodobacter*, or *Thalassospira.*

In certain embodiments, the Cas13 is Cas13a and originates from *Leptotrichia shahii, Listeria seeligeri, Lachnospiraceae bacterium* (such as Lb MA2020, Lb NK4A179, Lb NK4A144), *Clostridium aminophilum* (such as Ca DSM 10710), *Carnobacterium gallinarum* (such as Cg DSM 4847), *Paludibacter propionicigenes* (such as Pp WB4), *Listeria weihenstephanensis* (such as Lw FSL R9-0317), *Listeriaceae bacterium* (such as Lb FSL M6-0635), *Leptotrichia wadei* (such as Lw F0279), *Rhodobacter capsulatus* (such as Rc SB 1003, Rc R121, Rc DE442), *Leptotrichia buccalis* (such as Lb C-1013-b), *Herbinix hemicellulosilytica, Eubacteriaceae bacterium* (such as Eb CHKCI004), *Blautia.* sp Marseille-P2398, *Leptotrichia* sp. oral taxon 879 str. F0557, *Chloroflexus aggregans, Demequina aurantiaca, Thalassospira* sp. TSL5-1, *Pseudobutyrivibrio* sp. OR37, *Butyrivibrio* sp. YAB3001, *Leptotrichia* sp. Marseille-P3007, *Bacteroides ihuae, Porphyromonadaceae bacterium* (such as Pb KH3CP3RA), *Listeria riparia*, or *Insolitispirillum peregrinum.*

In certain embodiments, the Cas13 is Cas13b and originates from a species of the genus *Alistipes, Bacteroides, Bacteroidetes, Bergeyella, Capnocytophaga, Chryseobacterium, Flavobacterium, Myroides, Paludibacter, Phaeodactylibacter, Porphyromonas, Prevotella, Psychroflexus, Reichenbachiella, Riemerella*, or *Sinomicrobium.*

In certain embodiments, the Cas13 is Cas13b and originates from *Alistipes* sp. ZOR0009, *Bacteroides pyogenes* (such as Bp F0041), *Bacteroidetes bacterium* (such as Bb GWA2_31_9), *Bergeyella zoohelcum* (such as Bz ATCC 43767), *Capnocytophaga canimorsus, Capnocytophaga cynodegmi, Chryseobacterium carnipullorum, Chryseobacterium jejuense, Chryseobacterium ureilyticum, Flavobacterium branchiophilum, Flavobacterium columnare, Flavobacterium* sp. 316, *Myroides odoratimimus* (such as Mo CCUG 10230, Mo CCUG 12901, Mo CCUG 3837), *Paludibacter propionicigenes, Phaeodactylibacter xiamenensis, Porphyromonas gingivalis* (such as Pg F0185, Pg F0568, Pg JCVI SC001, Pg W4087, *Porphyromonas gulae, Porphyromonas* sp. COT-052 OH4946, *Prevotella aurantiaca, Prevotella buccae* (such as Pb ATCC 33574), *Prevotella falsenii, Prevotella intermedia* (such as Pi 17, Pi ZT), *Prevotella pallens* (such as Pp ATCC 700821), *Prevotella pleuritidis, Prevotella saccharolytica* (such as Ps F0055), *Prevotella* sp. MA2016, *Prevotella* sp. MSX73, *Prevotella* sp. P4-76, *Prevotella* sp. P5-119, *Prevotella* sp. P5-125, *Prevotella* sp. P5-60, *Psychroflexus torquis, Reichenbachiella agariperforans, Riemerella anatipestifer*, or *Sinomicrobium oceani*. In some examples, the Cas13 is *Riemerella anatipestifer* Cas13b. In some examples, when the Cas13 is a dead *Riemerella anatipestifer* Cas13. In some examples, the Cas13 is *Prevotella* sp. P5-125. In some examples, the Cas13 is a dead *Prevotella* sp. P5-125.

In certain embodiments, the Cas13 is Cas13c and originates from a species of the genus *Fusobacterium* or *Anaerosalibacter.*

In certain embodiments, the Cas13 is Cas13c and originates from *Fusobacterium necrophorum* (such as Fn subsp. *funduliforme* ATCC 51357, Fn DJ-2, Fn BFTR-1, Fn subsp. *Funduliforme*), *Fusobacterium perfoetens* (such as Fp ATCC 29250), *Fusobacterium ulcerans* (such as Fu ATCC 49185), or *Anaerosalibacter* sp. ND1.

In certain embodiments, the Cas13 is Cas13d and originates from a species of the genus *Eubacterium* or *Ruminococcus.*

In certain embodiments, the Cas13 is Cas13d and originates from *Eubacterium siraeum, Ruminococcus flavefaciens* (such as Rfx XPD3002), or *Ruminococcus albus.*

In certain embodiments, the invention provides an isolated Cas13 effector protein, comprising or consisting essentially of or consisting of or as set forth in Tables 1-4, and comprising one or more mutation as described herein elsewhere. A Tables 1-4 Cas13 effector protein is as discussed in more detail herein in conjunction with Tables 1-4. The invention provides an isolated nucleic acid encoding the Cas13 effector protein. In some embodiments of the invention the isolated nucleic acid comprises DNA sequence and further comprises a sequence encoding a crRNA. The invention provides an isolated eukaryotic cell comprising the nucleic acid encoding the Cas13 effector protein. Thus, herein, "Cas13 effector protein" or "effector protein" or "Cas" or "Cas protein" or "RNA targeting effector protein" or "RNA targeting protein" or like expressions is to be understood as including Cas13a, Cas13b, Cas13c, or Cas13d; expressions such as "RNA targeting CRISPR system" are to be understood as including Cas13a, Cas13b, Cas13c, or Cas13d CRISPR systems, and in certain embodiments can be read as a Tables 1-4 Cas13 effector protein CRISPR system; and references to guide RNA or sgRNA are to be read in conjunction with the herein-discussion of the Cas13 system crRNA, e.g., that which is sgRNA in other systems may be considered as or akin to crRNA in the instant invention.

The invention provides a method of identifying the requirements of a suitable guide sequence for the Cas13 effector protein of the invention (e.g., Tables 1-4), said method comprising:

(a) selecting a set of essential genes within an organism
(b) designing a library of targeting guide sequences capable of hybridizing to regions the coding regions of these genes as well as 5' and 3' UTRs of these genes
(c) generating randomized guide sequences that do not hybridize to any region within the genome of said organism as control guides
(d) preparing a plasmid comprising the RNA-targeting protein and a first resistance gene and a guide plasmid library comprising said library of targeting guides and said control guides and a second resistance gene,
(e) co-introducing said plasmids into a host cell
(f) introducing said host cells on a selective medium for said first and second resistance genes
(g) sequencing essential genes of growing host cells
(h) determining significance of depletion of cells transformed with targeting guides by comparing depletion of cells with control guides; and
(i) determining based on the depleted guide sequences the requirements of a suitable guide sequence.

In one aspect of such method, determining the PFS sequence for suitable guide sequence of the RNA-targeting protein is by comparison of sequences targeted by guides in depleted cells. In one aspect of such method, the method further comprises comparing the guide abundance for the different conditions in different replicate experiments. In one aspect of such method, the control guides are selected in that they are determined to show limited deviation in guide depletion in replicate experiments. In one aspect of such method, the significance of depletion is determined as (a) a depletion which is more than the most depleted control guide; or (b) a depletion which is more than the average depletion plus two times the standard deviation for the control guides. In one aspect of such method, the host cell is a bacterial host cell. In one aspect of such method, the step of co-introducing the plasmids is by electroporation and the host cell is an electro-competent host cell.

The invention provides a method of modifying sequences associated with or at a target locus of interest, the method comprising delivering to said locus a non-naturally occurring or engineered composition comprising a Cas13 effector protein and one or more nucleic acid components, wherein the effector protein forms a complex with the one or more nucleic acid components and upon binding of the said complex to the locus of interest the effector protein induces the modification of the sequences associated with or at the target locus of interest. In a preferred embodiment, the modification is the introduction of a strand break. In a preferred embodiment, the sequences associated with or at the target locus of interest comprises RNA or consists of RNA.

The invention provides a method of modifying sequences associated with or at a target locus of interest, the method comprising delivering to said locus a non-naturally occurring or engineered composition comprising a Cas13 effector protein, optionally a small accessory protein, and one or more nucleic acid components, wherein the effector protein forms a complex with the one or more nucleic acid components and upon binding of the said complex to the locus of interest the effector protein induces the modification of the sequences associated with or at the target locus of interest. In a preferred embodiment, the modification is the introduction of a strand break. In a preferred embodiment, the sequences associated with or at the target locus of interest comprises RNA or consists of RNA.

The invention provides a method of modifying sequences associated with or at a target locus of interest, the method comprising delivering to said sequences associated with or at the locus a non-naturally occurring or engineered composition comprising a Cas13 loci effector protein and one or more nucleic acid components, wherein the Cas13 effector protein forms a complex with the one or more nucleic acid components and upon binding of the said complex to the locus of interest the effector protein induces the modification of sequences associated with or at the target locus of interest. In a preferred embodiment, the modification is the introduction of a strand break. In a preferred embodiment the Cas13 effector protein forms a complex with one nucleic acid component; advantageously an engineered or non-naturally occurring nucleic acid component. The induction of modification of sequences associated with or at the target locus of interest can be Cas13 effector protein-nucleic acid guided. In a preferred embodiment the one nucleic acid component is a CRISPR RNA (crRNA). In a preferred embodiment the one nucleic acid component is a mature crRNA or guide RNA, wherein the mature crRNA or guide RNA comprises a spacer sequence (or guide sequence) and a direct repeat (DR) sequence or derivatives thereof. In a preferred embodiment the spacer sequence or the derivative thereof comprises a seed sequence, wherein the seed sequence is critical for recognition and/or hybridization to the sequence at the target locus. In a preferred embodiment of the invention the crRNA is a short crRNA that may be associated with a short DR sequence. In another embodiment of the invention the crRNA is a long crRNA that may be associated with a long DR sequence (or dual DR). Aspects of the invention relate to Cas13 effector protein complexes having one or more non-naturally occurring or engineered or modified or optimized nucleic acid components. In a preferred embodiment the nucleic acid component comprises RNA. In a preferred embodiment the nucleic acid component of the complex may comprise a guide sequence linked to a direct repeat sequence, wherein the direct repeat sequence comprises one or more stem loops or optimized secondary structures. In preferred embodiments of the invention, the direct repeat may be a short DR or a long DR (dual DR). In a preferred embodiment the direct repeat may be modified to comprise one or more protein-binding RNA aptamers. In a preferred embodiment, one or more aptamers may be included such as part of optimized secondary structure. Such aptamers may be capable of binding a bacteriophage coat protein. The bacteriophage coat protein may be selected from the group comprising Qβ, F2, GA, fr, JP501, MS2, M12, R17, BZ13, JP34, JP500, KU1, M11, MX1, TW18, VK, SP, FI, ID2, NL95, TW19, AP205, ϕCb5, ϕCb8r, ϕCb12r, ϕCb23r, 7s and PRR1. In a preferred embodiment the bacteriophage coat protein is MS2. The invention also provides for the nucleic acid component of the complex being 30 or more, 40 or more or 50 or more nucleotides in length.

The invention provides methods of genome editing or modifying sequences associated with or at a target locus of interest wherein the method comprises introducing a Cas13 complex into any desired cell type, prokaryotic or eukaryotic cell, whereby the Cas13 effector protein complex effectively functions to interfere with RNA in the eukaryotic or prokaryotic cell. In preferred embodiments, the cell is a eukaryotic cell and the RNA is transcribed from a mammalian genome or is present in a mammalian cell. In preferred methods of RNA editing or genome editing in human cells, the Cas13 effector proteins may include but are not limited to the specific species of Cas13 effector proteins disclosed herein.

The invention also provides a method of modifying a target locus of interest, the method comprising delivering to said locus a non-naturally occurring or engineered composition comprising a Cas13 effector protein and one or more nucleic acid components, wherein the Cas13 effector protein forms a complex with the one or more nucleic acid components and upon binding of the said complex to the locus of interest the effector protein induces the modification of the target locus of interest. In a preferred embodiment, the modification is the introduction of a strand break.

In such methods the target locus of interest may be comprised within a RNA molecule. In such methods the target locus of interest may be comprised in a RNA molecule in vitro.

In such methods the target locus of interest may be comprised in a RNA molecule within a cell. The cell may be a prokaryotic cell or a eukaryotic cell. The cell may be a mammalian cell. The modification introduced to the cell by the present invention may be such that the cell and progeny of the cell are altered for improved production of biologic products such as an antibody, starch, alcohol or other desired cellular output. The modification introduced to the cell by the present invention may be such that the cell and progeny of the cell include an alteration that changes the biologic product produced.

The mammalian cell many be a non-human mammal, e.g., primate, bovine, ovine, porcine, canine, rodent, Leporidae such as monkey, cow, sheep, pig, dog, rabbit, rat or mouse cell. The cell may be a non-mammalian eukaryotic cell such as poultry bird (e.g., chicken), vertebrate fish (e.g., salmon) or shellfish (e.g., oyster, claim, lobster, shrimp) cell. The cell may also be a plant cell. The plant cell may be of a monocot or dicot or of a crop or grain plant such as cassava, corn, sorghum, soybean, wheat, oat or rice. The plant cell may also be of an algae, tree or production plant, fruit or vegetable (e.g., trees such as citrus trees, e.g., orange, grapefruit or lemon trees; peach or nectarine trees; apple or pear trees; nut trees such as almond or walnut or pistachio trees; nightshade plants; plants of the genus *Brassica*; plants of the genus *Lectica*; plants of the genus *Spinalis*; plants of the genus *Capsicum*; cotton, tobacco, asparagus, carrot, cabbage, broccoli, cauliflower, tomato, eggplant, pepper, lettuce, spinach, strawberry, blueberry, raspberry, blackberry, grape, coffee, cocoa, etc).

The invention provides a method of modifying a target locus of interest, the method comprising delivering to said locus a non-naturally occurring or engineered composition comprising a Cas13 effector protein and one or more nucleic acid components, wherein the effector protein forms a complex with the one or more nucleic acid components and upon binding of the said complex to the locus of interest the effector protein induces the modification of the target locus of interest. In a preferred embodiment, the modification is the introduction of a strand break.

In such methods the target locus of interest may be comprised within an RNA molecule. In a preferred embodiment, the target locus of interest comprises or consists of RNA.

The invention also provides a method of modifying a target locus of interest, the method comprising delivering to said locus a non-naturally occurring or engineered composition comprising a Cas13 effector protein and one or more nucleic acid components, wherein the Cas13 effector protein forms a complex with the one or more nucleic acid components and upon binding of the said complex to the locus of interest the effector protein induces the modification of the target locus of interest. In a preferred embodiment, the modification is the introduction of a strand break.

Preferably, in such methods the target locus of interest may be comprised in a RNA molecule in vitro. Also preferably, in such methods the target locus of interest may be comprised in a RNA molecule within a cell. The cell may be a prokaryotic cell or a eukaryotic cell. The cell may be a mammalian cell. The cell may be a rodent cell. The cell may be a mouse cell.

In any of the described methods the target locus of interest may be a genomic or epigenomic locus of interest. In any of the described methods the complex may be delivered with multiple guides for multiplexed use. In any of the described methods more than one protein(s) may be used.

In further aspects of the invention the nucleic acid components may comprise a CRISPR RNA (crRNA) sequence. As the effector protein is a Cas13 effector protein, the nucleic acid components may comprise a CRISPR RNA (crRNA) sequence and generally may not comprise any trans-activating crRNA (tracr RNA) sequence.

In any of the described methods the effector protein and nucleic acid components may be provided via one or more polynucleotide molecules encoding the protein and/or nucleic acid component(s), and wherein the one or more polynucleotide molecules are operably configured to express the protein and/or the nucleic acid component(s). The one or more polynucleotide molecules may comprise one or more regulatory elements operably configured to express the protein and/or the nucleic acid component(s). The one or more polynucleotide molecules may be comprised within one or more vectors. In any of the described methods the target locus of interest may be a genomic, epigenomic, or transcriptomic locus of interest. In any of the described methods the complex may be delivered with multiple guides for multiplexed use. In any of the described methods more than one protein(s) may be used.

In any of the described methods the strand break may be a single strand break or a double strand break. In preferred embodiments the double strand break may refer to the breakage of two sections of RNA, such as the two sections of RNA formed when a single strand RNA molecule has folded onto itself or putative double helices that are formed with an RNA molecule which contains self-complementary sequences allows parts of the RNA to fold and pair with itself.

Regulatory elements may comprise inducible promotors. Polynucleotides and/or vector systems may comprise inducible systems.

In any of the described methods the one or more polynucleotide molecules may be comprised in a delivery system, or the one or more vectors may be comprised in a delivery system.

In any of the described methods the non-naturally occurring or engineered composition may be delivered via liposomes, particles including nanoparticles, exosomes, microvesicles, a gene-gun or one or more viral vectors.

The invention also provides a non-naturally occurring or engineered composition which is a composition having the characteristics as discussed herein or defined in any of the herein described methods.

In certain embodiments, the invention thus provides a non-naturally occurring or engineered composition, such as particularly a composition capable of or configured to modify a target locus of interest, said composition comprising a Cas13 effector protein and one or more nucleic acid components, wherein the effector protein forms a complex with the one or more nucleic acid components and upon binding of the said complex to the locus of interest the effector protein induces the modification of the target locus of interest. In certain embodiments, the effector protein may be a Cas13a, Cas13b, Cas13c, or Cas13d effector protein, preferably a Cas13b effector protein.

The invention also provides in a further aspect a non-naturally occurring or engineered composition, such as particularly a composition capable of or configured to modify a target locus of interest, said composition comprising: (a) a guide RNA molecule (or a combination of guide RNA molecules, e.g., a first guide RNA molecule and a second guide RNA molecule) or a nucleic acid encoding the guide RNA molecule (or one or more nucleic acids encoding the combination of guide RNA molecules); (b) a Cas13 effector protein. In certain embodiments, the effector protein may be a Cas13b effector protein.

The invention also provides in a further aspect a non-naturally occurring or engineered composition comprising: (I.) one or more CRISPR-Cas system polynucleotide sequences comprising (a) a guide sequence capable of hybridizing to a target sequence in a polynucleotide locus, (b) a tracr mate (i.e. direct repeat) sequence, and (II.) a second polynucleotide sequence encoding a Cas13 effector protein, wherein when transcribed, the guide sequence directs sequence-specific binding of a CRISPR complex to the target sequence, and wherein the CRISPR complex comprises the Cas13 effector protein complexed with the guide sequence that is hybridized to the target sequence. In certain embodiments, the effector protein may be a Cas13b effector protein.

In certain embodiments, a tracrRNA may not be required. Hence, the invention also provides in certain embodiments a non-naturally occurring or engineered composition comprising: (I.) one or more CRISPR-Cas system polynucleotide sequences comprising (a) a guide sequence capable of hybridizing to a target sequence in a polynucleotide locus, and (b) a direct repeat sequence, and (II.) a second polynucleotide sequence encoding a Cas13 effector protein, wherein when transcribed, the guide sequence directs sequence-specific binding of a CRISPR complex to the target sequence, and wherein the CRISPR complex comprises the Cas13 effector protein complexed with (1) the guide sequence that is hybridized to the target sequence, and (2) the direct repeat sequence. Preferably, the effector protein may be a Cas13b effector protein. Without limitation, the Applicants hypothesize that in such instances, the direct repeat sequence may comprise secondary structure that is sufficient for crRNA loading onto the effector protein. By means of example and not limitation, such secondary structure may comprise, consist essentially of or consist of a stem loop (such as one or more stem loops) within the direct repeat.

The invention also provides a vector system comprising one or more vectors, the one or more vectors comprising one or more polynucleotide molecules encoding components of a non-naturally occurring or engineered composition which is a composition having the characteristics as defined in any of the herein described methods.

The invention also provides a delivery system comprising one or more vectors or one or more polynucleotide molecules, the one or more vectors or polynucleotide molecules comprising one or more polynucleotide molecules encoding components of a non-naturally occurring or engineered composition which is a composition having the characteristics discussed herein or as defined in any of the herein described methods.

The invention also provides a non-naturally occurring or engineered composition, or one or more polynucleotides encoding components of said composition, or vector or delivery systems comprising one or more polynucleotides encoding components of said composition for use in a therapeutic method of treatment. The therapeutic method of treatment may comprise gene or genome editing, or gene therapy.

The invention also provides for methods and compositions wherein one or more amino acid residues of the effector protein may be modified e.g., an engineered or non-naturally-occurring Cas13 effector protein of or comprising or consisting or consisting essentially a Tables 1-4 protein. In an embodiment, the modification may comprise mutation of one or more amino acid residues of the effector protein. The one or more mutations may be in one or more catalytically active domains of the effector protein. The effector protein may have reduced or abolished nuclease activity compared with an effector protein lacking said one or more mutations. The effector protein may not direct cleavage of one RNA strand at the target locus of interest. In a preferred embodiment, the one or more mutations may comprise two mutations. In a preferred embodiment the one or more amino acid residues are modified in the Cas13 effector protein, e.g., an engineered or non-naturally-occurring Cas13 effector protein. In certain embodiments of the invention the effector protein comprises one or more HEPN domains. In a preferred embodiment, the effector protein comprises two HEPN domains. In another preferred embodiment, the effector protein comprises one HEPN domain at the C-terminus and another HEPN domain at the N-terminus of the protein. In certain embodiments, the one or more mutations or the two or more mutations may be in a catalytically active domain of the effector protein comprising a HEPN domain, or a catalytically active domain which is homologous to a HEPN domain. In certain embodiments, the effector protein comprises one or more of the following mutations: R116A, H121A, R1177A, H1182A (wherein amino acid positions correspond to amino acid positions of Group 29 protein originating from *Bergeyella zoohelcum* ATCC 43767). The skilled person will understand that corresponding amino acid positions in different Cas13 proteins may be mutated to the same effect. In certain embodiments, one or more mutations abolish catalytic activity of the protein completely or partially (e.g. altered cleavage rate, altered specificity, etc.) In certain embodiments, the effector protein as described herein is a "dead" effector protein, such as a dead Cas13 effector protein (i.e. dCas13b). In certain embodiments, the effector protein has one or more mutations in HEPN domain 1. In certain embodiments, the effector protein has one or more mutations in HEPN domain 2. In certain embodiments, the effector protein has one or more mutations in HEPN domain 1 and HEPN domain 2. The effector protein may comprise one or more heterologous functional domains. The one or more heterologous functional domains may comprise one or more nuclear localization signal (NLS) domains. The one or more heterologous functional domains may comprise at least two or more NLS domains. The one or more NLS domain(s) may be positioned at or near or in proximity to a terminus of the effector protein (e.g., Cas13b effector protein) and if two or more NLSs, each of the two may be positioned at or near or in proximity to a terminus of the effector protein (e.g., Cas13 effector protein). The one or more heterologous functional domains may comprise one or more transcriptional activation domains. In a preferred embodiment the transcriptional activation domain may comprise VP64. The one or more heterologous functional domains may comprise one or more transcriptional repression domains. In a preferred embodiment the transcriptional repression domain comprises a KRAB domain or a SID domain (e.g. SID4X). The one or more heterologous functional domains may comprise one or more nuclease domains. In a preferred embodiment a nuclease domain comprises Fok1.

The invention also provides for the one or more heterologous functional domains to have one or more of the following activities: methylase activity, demethylase activity, transcription activation activity, transcription repression activity, transcription release factor activity, histone modification activity, nuclease activity, single-strand RNA cleavage activity, double-strand RNA cleavage activity, single-strand DNA cleavage activity, double-strand DNA cleavage activity and nucleic acid binding activity. At least one or more heterologous functional domains may be at or near the amino-terminus of the effector protein and/or wherein at least one or more heterologous functional domains is at or near the carboxy-terminus of the effector protein. The one or more heterologous functional domains may be fused to the effector protein. The one or more heterologous functional domains may be tethered to the effector protein. The one or more heterologous functional domains may be linked to the effector protein by a linker moiety.

In certain embodiments, the Cas13 effector proteins as intended herein may be associated with a locus comprising short CRISPR repeats between 30 and 40 bp long, more typically between 34 and 38 bp long, even more typically between 36 and 37 bp long, e.g., 30, 31, 32, 33, 34, 35, 36, 37, 38, 39, or 40 bp long. In certain embodiments the CRISPR repeats are long or dual repeats between 80 and 350 bp long such as between 80 and 200 bp long, even more typically between 86 and 88 bp long, e.g., 80, 81, 82, 83, 84, 85, 86, 87, 88, 89, or 90 bp long In certain embodiments, a protospacer adjacent motif (PAM) or PAM-like motif directs binding of the effector protein (e.g. a Cas13 effector protein) complex as disclosed herein to the target locus of interest. In some embodiments, the PAM may be a 5' PAM (i.e., located upstream of the 5' end of the protospacer). In other embodiments, the PAM may be a 3' PAM (i.e., located downstream of the 5' end of the protospacer). In other embodiments, both a 5' PAM and a 3' PAM are required. In certain embodiments of the invention, a PAM or PAM-like motif may not be required for directing binding of the effector protein (e.g. a Cas13 effector protein). In certain embodiments, a 5' PAM is D (e.g., A, G, or U). In certain embodiments, a 5' PAM is D for Cas13b effectors. In certain embodiments of the invention, cleavage at repeat sequences may generate crRNAs (e.g. short or long crRNAs) containing a full spacer sequence flanked by a short nucleotide (e.g. 5, 6, 7, 8, 9, or 10 nt or longer if it is a dual repeat) repeat sequence at the 5' end (this may be referred to as a crRNA "tag") and the rest of the repeat at the 3'end. In certain embodiments, targeting by the effector proteins described herein may require the lack of homology between the crRNA tag and the target 5' flanking sequence. This requirement may be similar to that described further in Samai et al. "Co-transcriptional DNA and RNA Cleavage during Type III CRISPR-Cas Immunity" Cell 161, 1164-1174, May 21, 2015, where the requirement is thought to distinguish between bona fide targets on invading nucleic acids from the CRISPR array itself, and where the presence of repeat sequences will lead to full homology with the crRNA tag and prevent autoimmunity.

In certain embodiments, Cas13 effector protein is engineered and can comprise one or more mutations that reduce or eliminate nuclease activity, thereby reducing or eliminating RNA interfering activity. Mutations can also be made at neighboring residues, e.g., at amino acids near those that participate in the nuclease activity. In some embodiments, one or more putative catalytic nuclease domains are inactivated and the effector protein complex lacks cleavage activity and functions as an RNA binding complex. In a preferred embodiment, the resulting RNA binding complex may be linked with one or more functional domains as described herein.

In certain embodiments, the one or more functional domains are controllable, i.e. inducible.

In certain embodiments of the invention, the guide RNA or mature crRNA comprises, consists essentially of, or consists of a direct repeat sequence and a guide sequence or spacer sequence. In certain embodiments, the guide RNA or mature crRNA comprises, consists essentially of, or consists of a direct repeat sequence linked to a guide sequence or spacer sequence. In preferred embodiments of the invention, the mature crRNA comprises a stem loop or an optimized stem loop structure or an optimized secondary structure. In preferred embodiments the mature crRNA comprises a stem loop or an optimized stem loop structure in the direct repeat sequence, wherein the stem loop or optimized stem loop structure is important for cleavage activity. In certain embodiments, the mature crRNA preferably comprises a single stem loop. In certain embodiments, the direct repeat sequence preferably comprises a single stem loop. In certain embodiments, the cleavage activity of the effector protein complex is modified by introducing mutations that affect the stem loop RNA duplex structure. In preferred embodiments, mutations which maintain the RNA duplex of the stem loop may be introduced, whereby the cleavage activity of the effector protein complex is maintained. In other preferred embodiments, mutations which disrupt the RNA duplex structure of the stem loop may be introduced, whereby the cleavage activity of the effector protein complex is completely abolished.

The CRISPR system as provided herein can make use of a crRNA or analogous polynucleotide comprising a guide sequence, wherein the polynucleotide is an RNA, a DNA or a mixture of RNA and DNA, and/or wherein the polynucleotide comprises one or more nucleotide analogs. The sequence can comprise any structure, including but not limited to a structure of a native crRNA, such as a bulge, a hairpin or a stem loop structure. In certain embodiments, the polynucleotide comprising the guide sequence forms a duplex with a second polynucleotide sequence which can be an RNA or a DNA sequence.

The present disclosure also provides cells, tissues, organisms comprising the engineered CRISPR-Cas protein, the CRISPR-Cas systems, the polynucleotides encoding one or more components of the CRISPR-Cas systems, and/or vectors comprising the polynucleotides. The invention also provides for the nucleotide sequence encoding the effector protein being codon optimized for expression in a eukaryote or eukaryotic cell in any of the herein described methods or compositions. In an embodiment of the invention, the codon optimized effector protein is any Cas13 effector protein discussed herein and is codon optimized for operability in a eukaryotic cell or organism, e.g., such cell or organism as elsewhere herein mentioned, for instance, without limitation, a yeast cell, or a mammalian cell or organism, including a mouse cell, a rat cell, and a human cell or non-human eukaryote organism, e.g., plant.

In certain embodiments of the invention, at least one nuclear localization signal (NLS) is attached to the nucleic acid sequences encoding the Cas13 effector proteins. In preferred embodiments at least one or more C-terminal or N-terminal NLSs are attached (and hence nucleic acid molecule(s) coding for the Cas13 effector protein can include coding for NLS(s) so that the expressed product has the NLS(s) attached or connected). In a preferred embodiment a C-terminal NLS is attached for optimal expression and nuclear targeting in eukaryotic cells, preferably human cells. The invention also encompasses methods for delivering multiple nucleic acid components, wherein each nucleic acid component is specific for a different target locus of interest thereby modifying multiple target loci of interest. The nucleic acid component of the complex may comprise one or more protein-binding RNA aptamers. The one or more aptamers may be capable of binding a bacteriophage coat protein.

In a further aspect, the invention provides a eukaryotic cell comprising a modified target locus of interest, wherein the target locus of interest has been modified according to in any of the herein described methods. A further aspect provides a cell line of said cell. Another aspect provides a multicellular organism comprising one or more said cells.

In certain embodiments, the modification of the target locus of interest may result in: the eukaryotic cell comprising altered expression of at least one gene product; the eukaryotic cell comprising altered expression of at least one gene product, wherein the expression of the at least one gene product is increased; the eukaryotic cell comprising altered expression of at least one gene product, wherein the expression of the at least one gene product is decreased; or the eukaryotic cell comprising an edited genome.

In certain embodiments, the eukaryotic cell may be a mammalian cell or a human cell.

In further embodiments, the non-naturally occurring or engineered compositions, the vector systems, or the delivery systems as described in the present specification may be used for: site-specific gene knockout; site-specific genome editing; RNA sequence-specific interference; or multiplexed genome engineering.

Also provided is a gene product from the cell, the cell line, or the organism as described herein. In certain embodiments, the amount of gene product expressed may be greater than or less than the amount of gene product from a cell that does not have altered expression or edited genome. In certain embodiments, the gene product may be altered in comparison with the gene product from a cell that does not have altered expression or edited genome.

In another aspect, the invention provides a method for identifying novel nucleic acid modifying effectors, comprising: identifying putative nucleic acid modifying loci from a set of nucleic acid sequences encoding the putative nucleic acid modifying enzyme loci that are within a defined distance from a conserved genomic element of the loci, that comprise at least one protein above a defined size limit, or both; grouping the identified putative nucleic acid modifying loci into subsets comprising homologous proteins; identifying a final set of candidate nucleic acid modifying loci by selecting nucleic acid modifying loci from one or more subsets based on one or more of the following; subsets comprising loci with putative effector proteins with low domain homology matches to known protein domains relative to loci in other subsets, subsets comprising putative proteins with minimal distances to the conserved genomic element relative to loci in other subsets, subsets with loci comprising large effector proteins having a same orientations as putative adjacent accessory proteins relative to large effector proteins in other subsets, subset comprising putative effector proteins with lower existing nucleic acid modifying classifications relative to other loci, subsets comprising loci with a lower proximity to known nucleic acid modifying loci relative to other subsets, and total number of candidate loci in each subset.

In one embodiment, the set of nucleic acid sequences is obtained from a genomic or metagenomic database, such as a genomic or metagenomic database comprising prokaryotic genomic or metagenomic sequences.

In one embodiment, the defined distance from the conserved genomic element is between 1 kb and 25 kb.

In one embodiment, the conserved genomic element comprises a repetitive element, such as a CRISPR array. In a specific embodiment, the defined distance from the conserved genomic element is within 10 kb of the CRISPR array.

In one embodiment, the defined size limit of a protein comprised within the putative nucleic acid modifying (effector) locus is greater than 200 amino acids, or more particularly, the defined size limit is greater than 700 amino acids. In one embodiment, the putative nucleic acid modifying locus is between 900 to 1800 amino acids.

In one embodiment, the conserved genomic elements are identified using a repeat or pattern finding analysis of the set of nucleic acids, such as PILER-CR.

In one embodiment, the grouping step of the method described herein is based, at least in part, on results of a domain homology search or an HHpred protein domain homology search.

In one embodiment, the defined threshold is a BLAST nearest-neighbor cut-off value of 0 to 1e-7.

In one embodiment, the method described herein further comprises a filtering step that includes only loci with putative proteins between 900 and 1800 amino acids.

In one embodiment, the method described herein further comprises experimental validation of the nucleic acid modifying function of the candidate nucleic acid modifying effectors comprising generating a set of nucleic acid constructs encoding the nucleic acid modifying effectors and performing one or more biochemical validation assays, such as through the use of PAM validation in bacterial colonies, in vitro cleavage assays, the Surveyor method, experiments in mammalian cells, PFS validation, or a combination thereof.

In one embodiment, the method described herein further comprises preparing a non-naturally occurring or engineered composition comprising one or more proteins from the identified nucleic acid modifying loci.

In one embodiment, the identified loci comprise a Class 2 CRISPR effector, or the identified loci lack Cas1 or Cas2, or the identified loci comprise a single effector.

In one embodiment, the single large effector protein is greater than 900, or greater than 1100 amino acids in length, or comprises at least one HEPN domain.

In one embodiment, the at least one HEPN domain is near a N- or C-terminus of the effector protein, or is located in an interior position of the effector protein.

In one embodiment, the single large effector protein comprises a HEPN domain at the N- and C-terminus and two HEPN domains internal to the protein.

In one embodiment, the identified loci further comprise one or two small putative accessory proteins within 2 kb to 10 kb of the CRISPR array.

In one embodiment, a small accessory protein is less than 700 amino acids. In one embodiment, the small accessory protein is from 50 to 300 amino acids in length.

In one embodiment, the small accessory protein comprises multiple predicted transmembrane domains, or comprises four predicted transmembrane domains, or comprises at least one HEPN domain.

In one embodiment, the small accessory protein comprises at least one HEPN domain and at least one transmembrane domain.

In one embodiment, the loci comprise no additional proteins out to 25 kb from the CRISPR array.

In one embodiment, the CRISPR array comprises direct repeat sequences comprising about 36 nucleotides in length. In a specific embodiment, the direct repeat comprises a GTTG/GUUG at the 5' end that is reverse complementary to a CAAC at the 3' end.

In one embodiment, the CRISPR array comprises spacer sequences comprising about 30 nucleotides in length.

In one embodiment, the identified loci lack a small accessory protein.

The invention provides a method of identifying novel CRISPR effectors, comprising: a) identifying sequences in a genomic or metagenomic database encoding a CRISPR array; b) identifying one or more Open Reading Frames (ORFs) in said selected sequences within 10 kb of the CRISPR array; c) selecting loci based on the presence of a putative CRISPR effector protein between 900-1800 amino acids in size, d) selecting loci encoding a putative accessory protein of 50-300 amino acids; and e) identifying loci encoding a putative CRISPR effector and CRISPR accessory proteins and optionally classifying them based on structure analysis.

In one embodiment, the CRISPR effector is a Type VI CRISPR effector. In an embodiment, step (a) comprises i) comparing sequences in a genomic and/or metagenomic database with at least one pre-identified seed sequence that encodes a CRISPR array, and selecting sequences comprising said seed sequence; or ii) identifying CRISPR arrays based on a CRISPR algorithm.

In an embodiment, step (d) comprises identifying nuclease domains. In an embodiment, step (d) comprises identifying RuvC, HPN, and/or HEPN domains.

In an embodiment, no ORF encoding Cas1 or Cas2 is present within 10 kb of the CRISPR array In an embodiment, an ORF in step (b) encodes a putative accessory protein of 50-300 amino acids.

In an embodiment, putative novel CRISPR effectors obtained in step (d) are used as seed sequences for further comparing genomic and/or metagenomics sequences and subsequent selecting loci of interest as described in steps a) to d) of claim 1. In an embodiment, the pre-identified seed sequence is obtained by a method comprising: (a) identifying CRISPR motifs in a genomic or metagenomic database, (b) extracting multiple features in said identified CRISPR motifs, (c) classifying the CRISPR loci using unsupervised learning, (d) identifying conserved locus elements based on said classification, and (e) selecting therefrom a putative CRISPR effector suitable as seed sequence.

In an embodiment, the features include protein elements, repeat structure, repeat sequence, spacer sequence and spacer mapping. In an embodiment, the genomic and metagenomic databases are bacterial and/or archaeal genomes. In an embodiment, the genomic and metagenomic sequences are obtained from the Ensembl and/or NCBI™ genome databases. In an embodiment, the structure analysis in step (d) is based on secondary structure prediction and/or sequence alignments. In an embodiment, step (d) is achieved by clustering of the remaining loci based on the proteins they encode and manual curation of the obtained clusters. n another aspect, the disclosure provides a mutated Cas13 protein comprising one or more mutations of amino acids, wherein the amino acids: interact with a guide RNA that forms a complex with the mutated Cas 13 protein; or are in a HEPN active site, a lid domain which is a domain that caps the 3' end of the crRNA with two beta hairpins (see, e.g., FIG. 1, FIG. 18), a helical domain, selected from a helical 1 or a helical 2 domain, an inter-domain linker (IDL) domain, or a bridge helix domain of the engineered Cas 13 protein. In certain embodiments the helical domain 1 is helical domain 1-1, 1-2 or 1-3. In embodiments helical domain 2 is helical domain 2-1 or 2-2. In one aspect, the engineered Cas13 protein has a higher protease activity or polynucleotide-binding capability compared with a naturally-occurring counterpart Cas13 protein.

In some embodiments, the Cas13 protein is Cas13a, Cas13b, Cas13c, or Cas13d. In some embodiments, the Cas13 protein is Cas13b. In some embodiments, the amino acids interact with the guide RNA that forms a complex with the mutated Cas 13 protein. In some embodiments, the amino acids correspond to the following amino acids of *Prevotella buccae* Cas13b (PbCas13b): T405, H407, K457, H500, K570, K590, N634, R638, N652, N653, K655, S658, K741, K744, N756, S757, R762, R791, K846, K857, K870, and R877. In some embodiments, the amino acids are in a HEPN active site. In some embodiments, the amino acids correspond to the following amino acids of *Prevotella buccae* Cas13b (PbCas13b): amino acids 46-57, 73-79, 152-164, 1036-1046, and 1064-1074. In some embodiments, the amino acids correspond to the following amino acids of *Prevotella buccae* Cas13b (PbCas13b): R156, N157, H161, R1068, N1069, and H1073. In some embodiments, the amino acids are in the inter-domain linker domain of the mutated Cas 13 protein. In some embodiments, the amino acids correspond to the following amino acids of *Prevotella buccae* Cas13b (PbCas13b): R285, R287, K292, K294, E296, and N297. In some embodiments, the amino acids are in the bridge helix domain of the mutated Cas 13 protein. In some embodiments, the amino acids correspond to the following amino acids of *Prevotella buccae* Cas13b (PbCas13b): K826, K828, K829, R824, R830, Q831, K835, K836, and R838.

In another aspect, the disclosure provides a method of altering activity of a Cas13 protein, comprising: identifying one or more candidate amino acids in the Cas13 protein based on a three-dimensional structure of at least a portion of the Cas 13 protein, wherein the one or more candidate amino acids interact with a guide RNA that forms a complex with the Cas13 protein, or are in a HEPN active site, an inter-domain linker domain, or a bridge helix domain of the Cas13 protein; and mutating the one or more candidate amino acids thereby generating a mutated Cas13 protein, wherein activity the mutated Cas13 protein is different than the Cas13 protein.

In some embodiments, the Cas13 protein is Cas13a, Cas13b, Cas13c, or Cas13d. In some embodiments, the Cas13 protein is Cas13b. In some embodiments, the amino acids interact with the guide RNA that forms a complex with the mutated Cas 13 protein. In some embodiments, the amino acids correspond to the following amino acids of *Prevotella buccae* Cas13b (PbCas13b): T405, H407, K457, H500, K570, K590, N634, R638, N652, N653, K655, S658, K741, K744, N756, S757, R762, R791, K846, K857, K870, and R877. In some embodiments, the amino acids are in a HEPN active site. In some embodiments, the amino acids correspond to the following amino acids of *Prevotella buccae* Cas13b (PbCas13b): amino acids 46-57, 73-79, 152-164, 1036-1046, and 1064-1074. In some embodiments, the amino acids correspond to the following amino acids of *Prevotella buccae* Cas13b (PbCas13b): R156, N157, H161, R1068, N1069, and H1073. In some embodiments, the amino acids are in the inter-domain linker domain of the mutated Cas 13 protein. In some embodiments, the amino acids correspond to the following amino acids of *Prevotella buccae* Cas13b (PbCas13b): R285, R287, K292, K294, E296, and N297. In some embodiments, the amino acids are in the bridge helix domain of the mutated Cas 13 protein. In some embodiments, the amino acids correspond to the following amino acids of *Prevotella buccae* Cas13b (PbCas13b): K826, K828, K829, R824, R830, Q831, K835, K836, and R838.

In some embodiments, the Cas13 protein is Cas13b. In some embodiments, the Cas13b is a Cas13 ortholog smaller in size than Cas13 systems discovered to date. In some embodiments, the Cas 13b is Cas13b-t1, Cas13b-t1a, Cas13b-t2, or Cas13b-t3. In some embodiments, the Cas13b is Cas13b-t1. In some embodiments, the Cas13b is Cas13b-t1a. In some embodiments, the Cas13b is Cas13b-t2. In some embodiments, the Cas13b is Cas13b-t3.

Cas13 Orthologs

The terms "orthologue" (also referred to as "ortholog" herein) and "homologue" (also referred to as "homolog" herein) are well known in the art. By means of further guidance, a "homologue" of a protein as used herein is a protein of the same species which performs the same or a similar function as the protein it is a homologue of. Homologous proteins may but need not be structurally related, or are only partially structurally related. An "orthologue" of a protein as used herein is a protein of a different species which performs the same or a similar function as the protein it is an orthologue of. Orthologous proteins may but need not be structurally related, or are only partially structurally related. In particular embodiments, the homologue or orthologue of a Cas13 protein as referred to herein has a sequence homology or identity of at least 60%, preferably at least 70%, preferably at least 80%, more preferably at least 85%, even more preferably at least 90%, such as for instance at least 95% with a Cas13 effector protein set forth in Tables 1-4, below. In a preferred embodiment, the Cas13b effector protein may be of or from an organism identified in Tables 1-4 or the genus to which the organism belongs.

It has been found that a number of Cas13 orthologs are characterized by common motifs. Accordingly, in particular embodiments, the Cas13b effector protein is a protein comprising a sequence having at least 70% sequence identity with one or more of the sequences consisting of DKHXFGAFLNLARHN (SEQ ID NO:96), GLLFFVSLFLDK (SEQ ID NO:97), SKIXGFK (SEQ ID NO:98), DMLNELXRCP (SEQ ID NO:99), RXZDRFPYFALRYXD (SEQ ID NO:100) and LRFQVBLGXY (SEQ ID NO:101). In further particular embodiments, the Cas13b effector protein comprises a sequence having at least 70% sequence identity at least 2, 3, 4, 5 or all 6 of these sequences. In further particular embodiments, the sequence identity with these sequences is at least 75%, 80%, 85%, 90%, 95% or 100%. In further particular embodiments, the Cas13b effector protein is a protein comprising a sequence having 100% sequence identity with GLLFFVSLFL (SEQ ID NO:102) and RHQXRFPYF (SEQ ID NO:103). In further particular embodiments, the Cas13b effector is a Cas13b effector protein comprising a sequence having 100% sequence identity with RHQDRFPY (SEQ ID NO:104).

In particular embodiments, the Cas13b effector protein is a Cas13b effector protein having at least 65%, preferably at least 70%, 75%, 80%, 85%, 90%, 95% or more sequence identity with a Cas13b protein from *Prevotella buccae, Porphyromonas gingivales, Prevotella saccharolytica, Riemerella antipestifer*. In further particular embodiments, the Cas13b effector is selected from the Cas13b protein from *Bacteroides pyogenes, Prevotella* sp. MA2016, *Riemerella anatipestifer, Porphyromonas gulae, Porphyromonas gingivalis*, and *Porphyromonas* sp.COT-052OH4946.

It will be appreciated that orthologs of a Table 1 Cas13b enzyme that can be within the invention can include a chimeric enzyme comprising a fragment of a Table 1 Cas13b enzyme of multiple orthologs. Examples of such orthologs are described elsewhere herein. A chimeric enzyme may comprise a fragment of a Table 1 Cas13b enzyme and a fragment from another CRISPR enzyme, such as an ortholog of a Table 1 Cas13b enzyme of an organism which includes but is not limited to *Bergeyella, Prevotella, Porphyromonas, Bacteroides, Alistipes, Riemerella, Myroides, Flavobacterium, Capnocytophaga, Chryseobacterium, Phaeodactylibacter, Paludibacter* or *Psychroflexus*. A chimeric enzyme can comprise a first fragment and a second fragment, and the fragments, wherein one of the first and second a fragment is of or from a Table 1 Cas13b enzyme and the other fragment is of or from a CRISPR enzyme ortholog of a different species. In some cases, Cas13b is Cas13b-t. For example, Cas13b may be Cas13b-t1 (e.g., Cas13b-t1a), Cas13b-t2, or Cas13b-t3 (see, e.g. FIGS. 54A-54C).

In embodiments, the Cas13 RNA-targeting Cas13 effector proteins referred to herein also encompasses a functional variant of the effector protein or a homologue or an orthologue thereof. A "functional variant" of a protein as used herein refers to a variant of such protein which retains at least partially the activity of that protein. Functional variants may include mutants (which may be insertion, deletion, or replacement mutants), including polymorphs, etc., including as discussed herein in conjunction with Table 1. Also included within functional variants are fusion products of such protein with another, usually unrelated, nucleic acid, protein, polypeptide or peptide. Functional variants may be naturally occurring or may be man-made. In an embodiment, nucleic acid molecule(s) encoding the Cas13 RNA-targeting effector proteins, or an ortholog or homolog thereof, may be codon-optimized for expression in an eukaryotic cell. A eukaryote can be as herein discussed. Nucleic acid molecule(s) can be engineered or non-naturally occurring.

In an embodiment, the Cas13 RNA-targeting effector protein or an ortholog or homolog thereof, may comprise one or more mutations. The mutations may be artificially introduced mutations and may include but are not limited to one or more mutations in a catalytic domain, e.g., one or more mutations are introduced into one or more of the HEPN domains.

In an embodiment, the Cas13 protein or an ortholog or homolog thereof, may be used as a generic nucleic acid binding protein with fusion to or being operably linked to a functional domain. Exemplary functional domains may include but are not limited to translational initiator, translational activator, translational repressor, nucleases, in particular ribonucleases, a spliceosome, beads, a light inducible/controllable domain or a chemically inducible/controllable domain.

In an advantageous embodiment, the present invention encompasses Cas13 effector proteins with reference to Tables 1-5. In certain example embodiments, the Cas13 effector protein is from an organism identified in Tables 1-5. In certain example embodiments, the Cas13 effector protein is from an organism selected from *Bergeyella zoohelcum,*

*Prevotella intermedia, Prevotella buccae, Porphyromonas gingivalis, Bacteroides pyogenes, Alistipes* sp. ZOR0009, *Prevotella* sp. MA2016, *Riemerella anatipestifer, Prevotella aurantiaca, Prevotella saccharolytica, Myroides odoratimimus* CCUG 10230, *Capnocytophaga canimorsus, Porphyromonas gulae, Prevotella* sp. P5-125, *Flavobacterium branchiophilum, Myroides odoratimimus, Flavobacterium columnare*, or *Porphyromonas* sp. COT-052 OH4946. In another embodiment, the one or more guide RNAs are designed to bind to one or more target RNA sequences that are diagnostic for a disease state.

In certain example embodiments, the CRISPR effector protein is a Cas13b protein selected from Table 1.

TABLE 1

| | | |
|---|---|---|
| *Bergeyella zoohelcum* (SEQ ID No. 105) | 1 | MENKTSLGNNIYYNPFKPQDKSYFAGYFNAAMENTDSVFRELG<br>KRLKGKEYTSENFFDAIFKENISLVEYERYVKLLSDYFPMARLL<br>DKKEVPIKERKENFKKNFKGIIKAVRDLRNFYTHKEHGEVEITD<br>EIFGVLDEMLKSTVLTVKKKKVKTDKTKEILKKSIEKQLDILCQ<br>KKLEYLRDTARKIEEKRRNQRERGEKELVAPFKYSDKRDDLIA<br>AIYNDAFDVYIDKKKDSLKESSKAKYNTKSDPQQEEGDLKIPIS<br>KNGVVFLLSLFLTKQEIHAFKSKIAGFKATVIDEATVSEATVSHG<br>KNSICFMATHEIFSHLAYKKLKRKVRTAEINYGEAENAEQLSVY<br>AKETLMMQMLDELSKVPDVVYQNLSEDVQKTFIEDWNEYLKE<br>NNGDVGTMEEEQVIHPVIRKRYEDKFNYFAIRFLDEFAQFPTLR<br>FQVHLGNYLHDSRPKENLISDRRIKEKITVFGRLSELEHKKALFI<br>KNTETNEDREHYWEIFPNPNYDFPKENISVNDKDFPIAGSILDRE<br>KQPVAGKIGIKVKLLNQQYVSEVDKAVKAHQLKQRKASKPSIQ<br>NIIEEIVPINESNPKEAIVFGGQPTAYLSMNDIHSILYEFFDKWEK<br>KKEKLEKKGEKELRKEIGKELEKKIVGKIQAQIQQIIDKDTNAKI<br>LKPYQDGNSTAIDKEKLIKDLKQEQNILQKLKDEQTVREKEYN<br>DFIAYQDKNREINKVRDRNHKQYLKDNLKRKYPEAPARKEVL<br>YYREKGKVAVWLANDIKRFMPTDFKNEWKGEQHSLLQKSLAY<br>YEQCKEELKNLLPEKVFQHLPFKLGGYFQQKYLYQFYTCYLDK<br>RLEYISGLVQQAENFKSENKVFKKVENECFKFLKKQNYTHKEL<br>DARVQSILGYPIFLERGFMDEKPTIIKGKTFKGNEALFADWFRY<br>YKEYQNFQTFYDTENYPLVELEKKQADRKRKTKIYQQKKNDV<br>FTLLMAKHIFKSVFKQDSIDQFSLEDLYQSREERLGNQERARQT<br>GERNTNYIWNKTVDLKLCDGKITVENVKLKNVGDFIKYEYDQR<br>VQAFLKYEENIEWQAFLIKESKEEENYPYVVEREIEQYEKVRRE<br>ELLKEVHLIEEYILEKVKDKEILKKGDNQNFKYYILNGLLKQLK<br>NEDVESYKVFNLNTEPEDVNINQLKQEATDLEQKAFVLTYIRN<br>KFAHNQLPKKEFWDYCQEKYGKIEKEKTYAEYFAEVFKKEKE<br>ALIK |
| *Prevotella intermedia* (SEQ ID No. 106) | 2 | MEDDKKTTDSIRYELKDKHFWAAFLNLARHNVYITVNHINKIL<br>EEGEINRDGYETTLKNTWNEIKDINKKDRLSKLIIKHFPFLEAAT<br>YRLNPTDTTKQKEEKQAEAQSLESLRKSFFVFIYKLRDLRNHYS<br>HYKHSKSLERPKFEEGLLEKMYNIFNASIRLVKEDYQYNKDINP<br>DEDFKHLDRTEEEFNYYFTKDNEGNITESGLLFFVSLFLEKKDAI<br>WMQQKLRGFKDNRENKKKMTNEVFCRSRMLLPKLRLQSTQTQ<br>DWILLDMLNELIRCPKSLYERLREEDREKFRVPIEIADEDYDAEQ<br>EPFKNTLVRHQDRFPYFALRYFDYNEIFTNLRFQIDLGTYHFSIY<br>KKQIGDYKESHHLTHKLYGFERIQEFTKQNRPDEWRKFVKTFN<br>SFETSKEPYIPETTPHYHLENQKIGIRFRNDNDKIWPSLKTNSEK<br>NEKSKYKLDKSFQAEAFLSVHELLPMMFYYLLLKTENTDNDNE<br>IETKKKENKNDKQEKHKIEEIIENKITEIYALYDTFANGEIKSIDE<br>LEEYCKGKDIEIGHLPKQMIAILKDEHKVMATEAERKQEEMLV<br>DVQKSLESLDNQINEEIENVERKNSSLKSGKIASWLVNDMMRF<br>QPVQKDNEGKPLNNSKANSTEYQLLQRTLAFFGSEHERLAPYF<br>KQTKLIESSNPHPFLKDTEWEKCNNILSFYRSYLEAKKNFLESLK<br>PEDWEKNQYFLKLKEPKTKPKTLVQGWKNGFNLPRGIFTEPIRK<br>WFMKHRENITVAELKRVGLVAKVIPLFFSEEYKDSVQPFYNYH<br>FNVGNINKPDEKNFLNCEERRELLRKKKDEFKKMTDKEKEENP<br>SYLEFKSWNKFERELRLVRNQDIVTWLLCMELFNKKKIKELNV<br>EKIYLKNINTNTTKKEKNTEEKNGEEKNIKEKNNILNRIMPMRL<br>PIKVYGRENFSKNKKKKIRRNTFFTVYIEEKGTKLLKQGNFKAL<br>ERDRRLGGLFSFVKTPSKAESKSNTISKLRVEYELGEYQKARIEII<br>KDMLALEKTLIDKYNSLDTDNFNKMLTDWLELKGEPDKASFQ<br>NDVDLLIAVRNAFSHNQYPMRNRIAFANINPFSLSSANTSEEKG<br>LGIANQLKDKTHKTIEKIIEIEKPIETKE |
| *Prevotella buccae* (SEQ ID No. 107) WP_004343973.1 | 3 | MQKQDKLFVDRKKNAIFAFPKYITIMENKEKPEPIYYELTDKHF<br>WAAFLNLARHNVYTTINHINRRLEIAELKDDGYMMGIKGSWNE<br>QAKKLDKKVRLRDLIMKHFPFLEAAAYEMTNSKSPNNKEQRE<br>KEQSEALSLNNLKNVLFIFLEKLQVLRNYYSHYKYSEESPKPIFE<br>TSLLKNMYKVFDANVRLVKRDYMHHENIDMQRDFTHLNRKK<br>QVGRTKNIIDSPNFHYHFADKEGNMTIAGLLFFVSLFLDKKDAI<br>WMQKKLKGFKDGRNLREQMTNEVFCRSRISLPKLKLENVQTK<br>DWMQLDMLNELVRCPKSLYERLREKDRESFKVPFDIFSDDYNA<br>EEEPFKNTLVRHQDRFPYFVLRYFDLNEIFEQLRFQIDLGTYHFS<br>IYNKRIGDEDEVRHLTHHLYGFARIQDFAPQNQPEEWRKLVKD<br>LDHFETSQEPYISKTAPHYHLENEKIGIKFCSAHNNLFPSLQTDK<br>TCNGRSKFNLGTQFTAEAFLSVHELLPMMFYYLLLTKDYSRKE<br>SADKVEGIIRKEISNIYAIYDAFANNEINSIADLTRRLQNTNILQG<br>HLPKQMISILKGRQKDMGKEAERKIGEMIDDTQRRLDLLCKQT |

TABLE 1-continued

| | | |
|---|---|---|
| | | NQKIRIGKRNAGLLKSGKIADWLVNDMMRFQPVQKDQNNIPIN<br>NSKANSTEYRMLQRALALFGSENFRLKAYFNQMNLVGNDNPH<br>PFLAETQWEHQTNILSFYRNYLEARKKYLKGLKPQNWKQYQH<br>FLILKVQKTNRNTLVTGWKNSFNLPRGIFTQPIREWFEKHNNSK<br>RIYDQILSFDRVGFVAKAIPLYFAEEYKDNVQPFYDYPFNIGNRL<br>KPKKRQFLDKKERVELWQKNKELFKNYPSEKKKTDLAYLDFLS<br>WKKFERELRLIKNQDIVTWLMFKELFNMATVEGLKIGEIHLRDI<br>DTNTANEESNNILNRIMPMKLPVKTYETDNKGNILKERPLATFY<br>IEETETKVLKQGNFKALVKDRRLNGLFSFAETTDLNLEEHPISKL<br>SVDLELIKYQTTRISIFEMTLGLEKKLIDKYSTLPTDSFRNMLER<br>WLQCKANRPELKNYVNSLIAVRNAFSHNQYPMYDATLFAEVK<br>KFTLFPSVDTKKIELNIAPQLLEIVGKAIKEIEKSENKN |
| *Porphyromonas gingivalis* (SEQ ID No. 108) | 4 | MNTVPASENKGQSRTVEDDPQYFGLYLNLARENLIEVESHVRIK<br>FGKKKLNEESLKQSLLCDHLLSVDRWTKVYGHSRRYLPFLHYF<br>DPDSQIEKDHDSKTGVDPDSAQRLIRELYSLLDFLRNDFSHNRL<br>DGTTFEHLEVSPDISSFITGTYSLACGRAQSRFAVFFKPDDFVLA<br>KNRKEQLISVADGKECLTVSGFAFFICLFLDREQASGMLSRIRGF<br>KRTDENWARAVHETFCDLCIRHPHDRLESSNTKEALLLDMLNE<br>LNRCPRILYDMLPEEERAQFLPALDENSMNNLSENSLDEESRLL<br>WDGSSDWAEALTKRIRHQDRFPYLMLRFIEEMDLLKGIRFRVD<br>LGEIELDSYSKKVGRNGEYDRTITDHALAFGKLSDFQNEEEVSR<br>MISGEASYPVRFSLFAPRYAIYDNKIGYCHTSDPVYPKSKTGEK<br>RALSNPQSMGFISVHDLRKLLLMELLCEGSFSRMQSDFLRKANR<br>ILDETAEGKLQFSALFPEMRHRFIPPQNPKSKDRREKAETTLEKY<br>KQEIKGRKDKLNSQLLSAFDMDQRQLPSRLLDEWMNIRPASHS<br>VKLRTYVKQLNEDCRLRLRKFRKDGDGKARAIPLVGEMATFLS<br>QDIVRMIISEETKKLITSAYYNEMQRSLAQYAGEENRRQFRAIV<br>AELRLLDPSSGHPFLSATMETAHRYTEGFYKCYLEKKREWLAK<br>IFYRPEQDENTKRRISVFFVPDGEARKLLPLLIRRRMKEQNDLQ<br>DWIRNKQAHPIDLPSHLFDSKVMELLKVKDGKKKWNEAFKDW<br>WSTKYPDGMQPFYGLRRELNIHGKSVSYIPSDGKKFADCYTHL<br>MEKTVRDKKRELRTAGKPVPPDLAADIKRSFHRAVNEREFMLR<br>LVQEDDRLMLMAINKMMTDREEDILPGLKNIDSILDEENQFSLA<br>VHAKVLEKEGEGGDNSLSLVPATIEIKSKRKDWSKYIRYRYDR<br>RVPGLMSHFPEHKATLDEVKTLLGEYDRCRIKIFDWAFALEGAI<br>MSDRDLKPYLHESSSREGKSGEHSTLVKMLVEKKGCLTPDESQ<br>YLILIRNKAAHNQFPCAAEMPLIYRDVSAKVGSIEGSSAKDLPE<br>GSSLVDSLWKKYEMIIRKILPILDPENRFFGKLLNNMSQPINDL |
| *Bacteroides pyogenes* (SEQ ID No. 109) | 5 | MESIKNSQKSTGKTLQKDPPYFGLYLNMALLNVRKVENHIRKW<br>LGDVALLPEKSGFHSLLTTDNLSSAKWTRFYYKSRKFLPFLEMF<br>DSDKKSYENRRETAECLDTIDRQKISSLLKEVYGKLQDIRNAFS<br>HYHIDDQSVKHTALIISSEMHRFIENAYSFALQKTRARFTGVFVE<br>TDFLQAEEKGDNKKFFAIGGNEGIKLKDNALIFLICLFLDREEAF<br>KFLSRATGFKSTKEKGFLAVRETFCALCCRQPHERLLSVNPREA<br>LLMDMLNELNRCPDILFEMLDEKDQKSFLPLLGEEEQAHILENS<br>LNDELCEAIDDPFEMIASLSKRVRYKNRFPYLMLRYIEEKNLLPF<br>IRFRIDLGCLELASYPKKMGEENNYERSVTDHAMAFGRLTDFH<br>NEDAVLQQITKGITDEVRFSLYAPRYAIYNNKIGFVRTSGSDKIS<br>FPTLKKKGGEGHCVAYTLQNTKSFGFISIYDLRKILLLSFLDKDK<br>AKNIVSGLLEQCEKHWKDLSENLFDAIRTELQKEFPVPLIRYTLP<br>RSKGGKLVSSKLADKQEKYESEFERRKEKLTEILSEKDFDLSQIP<br>RRMIDEWLNVLPTSREKKLKGYVETLKLDCRERLRVFEKREKG<br>EHPLPPRIGEMATDLAKDIIRMVIDQGVKQRITSAYYSEIQRCLA<br>QYAGDDNRRHLDSIIRELRLKDTKNGHPFLGKVLRPGLGHTEK<br>LYQRYFEEKKEWLEATFYPAASPKRVPRFVNPPTGKQKELPLII<br>RNLMKERPEWRDWKQRKNSHPIDLPSQLFENEICRLLKDKIGKE<br>PSGKLKWNEMFKLYWDKEFPNGMQRFYRCKRRVEVFDKVVE<br>YEYSEEGGNYKKYYEALIDEVVRQKISSSKEKSKLQVEDLTLSV<br>RRVFKRAINEKEYQLRLLCEDDRLLFMAVRDLYDWKEAQLDL<br>DKIDNMLGEPVSVSQVIQLEGGQPDAVIKAECKLKDVSKLMRY<br>CYDGRVKGLMPYFANHEATQEQVEMELRHYEDHRRRVFNWV<br>FALEKSVLKNEKLRRFYEESQGGCEHRRCIDALRKASLVSEEEY<br>EFLVHIRNKSAHNQFPDLEIGKLPPNVTSGFCECIWSKYKAIICRI<br>IPFIDPERRFFGKLLEQK |
| *Alistipes* sp. ZOR0009 (SEQ ID No. 110) | 6 | MSNEIGAFREHQFAYAPGNEKQEEATFATYFNLALSNVEGMMF<br>GEVESNPDKIEKSLDTLPPAILRQIASFIWLSKEDHPDKAYSTEE<br>VKVIVTDLVRRLCFYRNYFSHCFYLDTQYFYSDELVDTTAIGEK<br>LPYNFHHFITNRLFRYSLPEITLFRWNEGERKYEILRDGLIFFCCL<br>FLKRGQAERFLNELRFFKRTDEEGRIKRTIFTKYCTRESHKHIGIE<br>EQDFLIFQDIIGDLNRVPKVCDGVVDLSKENERYIKNRETSNESD<br>ENKARYRLLIREKDKFPYYLMRYIVDFGVLPCITFKQNDYSTKE<br>GRGQFHYQDAAVAQEERCYNFVVRNGNVYYSYMPQAQNVVR<br>ISELQGTISVEELRNMVYASINGKDVNKSVEQYLYHLHLLYEKI<br>LTISGQTIKEGRVDVEDYRPLLDKLLLRPASNGEELRRELRKLLP<br>KRVCDLLSNRFDCSEGVSAVEKRLKAILLRHEQLLLSQNPALHI<br>DKIKSVIDYLYLFFSDDEKFRQQPTEKAHRGLKDEEFQMYHYL<br>VGDYDSHPLALWKELEASGRLKPEMRKLTSATSLHGLYMLCL |

TABLE 1-continued

| | | |
|---|---|---|
| | | KGTVEWCRKQLMSIGKGTAKVEAIADRVGLKLYDKLKEYTPE QLEREVKLVVMHGYAAAATPKPKAQAAIPSKLTELRFYSFLGK REMSFAAFIRQDKKAQKLWLRNFYTVENIKTLQKRQAAADAA CKKLYNLVGEVERVHTNDKVLVLVAQRYRERLLNVGSKCAVT LDNPERQQKLADVYEVQNAWLSIRFDDLDFTLTHVNLSNLRKA YNLIPRKHILAFKEYLDNRVKQKLCEECRNVRRKEDLCTCCSPR YSNLTSWLKENHSESSIEREAATMMLLDVERKLLSFLLDERRKA IIEYGKFIPFSALVKECRLADAGLCGIRNDVLHDNVISYADAIGK LSAYFPKEASEAVEYIRRTKEVREQRREELMANSSQ |
| *Prevotella* sp. MA2016 (SEQ ID No. 111) | 7a | MSKECKKQRQEKKRRLQKANFSISLTGKHVFGAYFNMARTNF VKTINYILPIAGVRGNYSENQINKMLHALFLIQAGRNEELTTEQK QWEKKLRLNPEQQTKFQKLLFKHFPVLGPMMADVADHKAYL NKKKSTVQTEDETFAMLKGVSLADCLDIICLMADTLTECRNFY THKDPYNKPSQLADQYLHQEMIAKKLDKVVVASRRILKDREGL SVNEVEFLTGIDHLHQEVLKDEFGNAKVKDGKVMKTFVEYDD FYFKISGKRLVNGYTVTTKDDKPVNVNTMLPALSDFGLLYFCV LFLSKPYAKLFIDEVRLFEYSPFDDKENMIMSEMLSIYRIRTPRL HKIDSHDSKATLAMDIFGELRRCPMELYNLLDKNAGQPFFHDE VKHPNSHTPDVSKRLRYDDRFPTLALRYIDETELFKRIRFQLQL GSFRYKFYDKENCIDGRVRVRRIQKEINGYGRMQEVADKRMD KWGDLIQKREERSVKLEHEELYINLDQFLEDTADSTPYVTDRRP AYNIHANRIGLYWEDSQNPKQYKVFDENGMYIPELVVTEDKKA PIKMPAPRCALSVYDLPAMLFYEYLREQQDNEFPSAEQVIIEYE DDYRKFFKAVAEGKLKPFKRPKEFRDFLKKEYPKLRMADIPKK LQLFLCSHGLCYNNKPETVYERLDRLTLQHLEERELHIQNRLEH YQKDRDMIGNKDNQYGKKSFSDVRHGALARYLAQSMMEWQP TKLKDKEKGHDKLTGLNYNVLTAYLATYGHPQVPEEGFTPRTL EQVLINAHLIGGSNPHPFINKVLALGNRNIEELYLHYLEEELKHI RSRIQSLSSNPSDKALSALPFIHHDRMRYHERTSEEMMALAARY TTIQLPDGLFTPYILEILQKHYTENSDLQNALSQDVPVKLNPTCN AAYLITLFYQTVLKDNAQPFYLSDKTYTRNKDGEKAESFSFKR AYELFSVLNNNKKDTFPFEMIPLFLTSDEIQERLSAKLLDGDGNP VPEVGEKGKPATDSQGNTIWKRRIYSEVDDYAEKLTDRDMKIS FKGEWEKLPRWKQDKIIKRRDETRRQMRDELLQRMPRYIRDIK DNERTLRRYKTQDMVLFLLAEKMFTNIISEQSSEFNWKQMRLS KVCNEAFLRQTLTFRVPVTVGETTIYVEQENMSLKNYGEFYRFL TDDRLMSLLNNIVETLKPNENGDLVIRHTDLMSELAAYDQYRS TIFMLIQSIENLIITNNAVLDDPDADGFWVREDLPKRNNFASLLE LINQLNNVELTDDERKLLVAIRNAFSHNSYNIDFSLIKDVKHLPE VAKGILQHLQSMLGVEITK |
| *Prevotella* sp. MA2016 (SEQ ID No. 112) | 7b | MSKECKKQRQEKKRRLQKANFSISLTGKHVFGAYFNMARTNF VKTINYILPIAGVRGNYSENQINKMLHALFLIQAGRNEELTTEQK QWEKKLRLNPEQQTKFQKLLFKHFPVLGPMMADVADHKAYL NKKKSTVQTEDETFAMLKGVSLADCLDIICLMADTLTECRNFY THKDPYNKPSQLADQYLHQEMIAKKLDKVVVASRRILKDREGL SVNEVEFLTGIDHLHQEVLKDEFGNAKVKDGKVMKTFVEYDD FYFKISGKRLVNGYTVTTKDDKPVNVNTMLPALSDFGLLYFCV LFLSKPYAKLFIDEVRLFEYSPFDDKENMIMSEMLSIYRIRTPRL HKIDSHDSKATLAMDIFGELRRCPMELYNLLDKNAGQPFFHDE VKHPNSHTPDVSKRLRYDDRFPTLALRYIDETELFKRIRFQLQL GSFRYKFYDKENCIDGRVRVRRIQKEINGYGRMQEVADKRMD KWGDLIQKREERSVKLEHEELYINLDQFLEDTADSTPYVTDRRP AYNIHANRIGLYWEDSQNPKQYKVFDENGMYIPELVVTEDKKA PIKMPAPRCALSVYDLPAMLFYEYLREQQDNEFPSAEQVIIEYE DDYRKFFKAVAEGKLKPFKRPKEFRDFLKKEYPKLRMADIPKK LQLFLCSHGLCYNNKPETVYERLDRLTLQHLEERELHIQNRLEH YQKDRDMIGNKDNQYGKKSFSDVRHGALARYLAQSMMEWQP TKLKDKEKGHDKLTGLNYNVLTAYLATYGHPQVPEEGFTPRTL EQVLINAHLIGGSNPHPFINKVLALGNRNIEELYLHYLEEELKHI RSRIQSLSSNPSDKALSALPFIHHDRMRYHERTSEEMMALAARY TTIQLPDGLFTPYILEILQKHYTENSDLQNALSQDVPVKLNPTCN AAYLITLFYQTVLKDNAQPFYLSDKTYTRNKDGEKAESFSFKR AYELFSVLNNNKKDTFPFEMIPLFLTSDEIQERLSAKLLDGDGNP VPEVGEKGKPATDSQGNTIWKRRIYSEVDDYAEKLTDRDMKIS FKGEWEKLPRWKQDKIIKRRDETRRQMRDELLQRMPRYIRDIK DNERTLRRYKTQDMVLFLLAEKMFTNIISEQSSEFNWKQMRLS KVCNEAFLRQTLTFRVPVTVGETTIYVEQENMSLKNYGEFYRFL TDDRLMSLLNNIVETLKPNENGDLVIRHTDLMSELAAYDQYRS TIFMLIQSIENLIITNNAVLDDPDADGFWVREDLPKRNNFASLLE LINQLNNVELTDDERKLLVAIRNAFSHNSYNIDFSLIKDVKHLPE VAKGILQHLQSMLGVEITK |
| *Riemerella anatipestifer* (SEQ ID No. 113) | 8 | MEKPLLPNVYTLKHKFFWGAFLNIARHNAFITICHINEQLGLKT PSNDDKIVDVVCETWNNILNNDHDLLKKSQLTELILKHFPFLTA MCYHPPKKEGKKKGHQKEQQKEKESEAQSQAEALNPSKLIEAL EILVNQLHSLRNYYSHYKHKKPDAEKDIFKHLYKAFDASLRMV KEDYKAHFTVNLTRDFAHLNRKGKNKQDNPDFNRYRFEKDGF FTESGLLFFTNLFLDKRDAYWMLKKVSGFKASHKQREKMTTE |

TABLE 1-continued

| | | |
|---|---|---|
| | | VFCRSRILLPKLRLESRYDHNQMLLDMLSELSRCPKLLYEKLSE ENKKHFQVEADGFLDEIEEEQNPFKDTLIRHQDRFPYFALRYLD LNESFKSIRFQVDLGTYHYCIYDKKIGDEQEKRHLTRTLLSFGRL QDFTEINRPQEWKALTKDLDYKETSNQPFISKTTPHYHITDNKIG FRLGTSKELYPSLEIKDGANRIAKYPYNSGFVAHAFISVHELLPL MFYQHLTGKSEDLLKETVRHIQRIYKDFEEERINTIEDLEKANQ GRLPLGAFPKQMLGLLQNKQPDLSEKAKIKIEKLIAETKLLSHR LNTKLKSSPKLGKRREKLIKTGVLADWLVKDFMRFQPVAYDA QNQPIKSSKANSTEFWFIRRALALYGGEKNRLEGYFKQTNLIGN TNPHPFLNKFNWKACRNLVDFYQQYLEQREKFLEAIKNQPWEP YQYCLLLKIPKENRKNLVKGWEQGGISLPRGLFTEAIRETLSED LMLSKPIRKEIKKHGRVGFISRAITLYFKEKYQDKHQSFYNLSY KLEAKAPLLKREEHYEYWQQNKPQSPTESQRLELHTSDRWKD YLLYKRWQHLEKKLRLYRNQDVMLWLMTLELTKNHFKELNL NYHQLKLENLAVNVQEADAKLNPLNQTLPMVLPVKVYPATAF GEVQYHKTPIRTVYIREEHTKALKMGNFKALVKDRRLNGLFSFI KEENDTQKHPISQLRLRRELEIYQSLRVDAFKETLSLEEKLLNKH TSLSSLENEFRALLEEWKKEYAASSMVTDEHIAFIASVRNAFCH NQYPFYKEALHAPIPLFTVAQPTTEEKDGLGIAEALLKVLREYC EIVKSQI |
| *Prevotella aurantiaca* (SEQ ID No. 114) | 9 | MEDDKKTTGSISYELKDKHFWAAFLNLARHNVYITINHINKLLE IREIDNDEKVLDIKTLWQKGNKDLNQKARLRELMTKHFPFLET AIYTKNKEDKKEVKQEKQAEAQSLESLKDCLFLFLDKLQEARN YYSHYKYSEFSKEPEFEEGLLEKMYNIFGNNIQLVINDYQHNKD INPDEDFKHLDRKGQFKYSFADNEGNITESGLLFFVSLFLEKKD AIWMQQKLNGFKDNLENKKKMTHEVFCRSRILMPKLRLESTQT QDWILLDMLNELIRCPKSLYERLQGDDREKFKVPFDPADEDYN AEQEPFKNTLIRHQDRFPYFVLRYFDYNEIFKNLRFQIDLGTYHF SIYKKLIGGQKEDRHLTHKLYGFERIQEFAKQNRPDEWKAIVKD LDTYETSNKRYISETTPHYHLENQKIGIRFRNGNKEIWPSLKTND ENNEKSKYKLDKQYQAEAFLSVHELLPMMFYYLLLKKEKPNN DEINASIVEGFIKREIRNIFKLYDAFANGEINNIDDLEKYCADKGI PKRHLPKQMVAILYDEHKDMVKEAKRKQKEMVKDTKKLLAT LEKQTQKEKEDDGRNVKLLKSGEIARWLVNDMMRFQPVQKD NEGKPLNNSKANSTEYQMLQRSLALYNNEEKPTRYFRQVNLIE SNNPHPFLKWTKWEECNNILTFYYSYLTKKIEFLNKLKPEDWK KNQYFLKLKEPKTNRETLVQGWKNGFNLPRGIFTEPIREWFKR HQNNSKEYEKVEALDRVGLVTKVIPLFFKEEYFKDKEENFKED TQKEINDCVQPFYNFPYNVGNIHKPKEKDFLHREERIELWDKKK DKFKGYKEKIKSKKLTEKDKEEFRSYLEFQSWNKFERELRLVR NQDIVTWLLCKELIDKLKIDELNIEELKKLRLNNIDTDTAKKEK NNILNRVMPMELPVTVYEIDDSHKIVKDKPLHTIYIKEAETKLL KQGNFKALVKDRRLNGLFSFVKTNSEAESKRNPISKLRVEYELG EYQEARIEIIQDMLALEEKLINKYKDLPTNKFSEMLNSWLEGKD EADKARFQNDVDFLIAVRNAFSHNQYPMHNKIEFANIKPFSLYT ANNSEEKGLGIANQLKDKTKETTDKIKKIEKPIETKE |
| *Prevotella saccharolytica* (SEQ ID No. 115) | 10 | MEDKPFWAAFFNLARHNVYLTVNHINKLLDLEKLYDEGKHKEI FEREDIFNISDDVMNDANSNGKKRKLDIKKIWDDLDTDLTRKY QLRELILKHFPFIQPAIIGAQTKERTTIDKDKRSTSTSNDSLKQTG EGDINDLLSLSNVKSMFFRLLQILEQLRNYYSHVKHSKSATMPN FDEDLLNWMRYIFIDSVNKVKEDYSSNSVIDPNTSFSHLIYKDE QGKIKPCRYPFTSKDGSINAFGLLFFVSLFLEKQDSIWMQKKIPG FKKASENYMKMTNEVFCRNHILLPKIRLETVYDKDWMLLDML NEVVRCPLSLYKRLTPAAQNKFKVPEKSSDNANRQEDDNPFSRI LVRHQNRFPYFVLRFFDLNEVFTTLRFQINLGCYHFAICKKQIGD KKEVHHLIRTLYGFSRLQNFTQNTRPEEWNTLVKTTEPSSGNDG KTVQGVPLPYISYTIPHYQIENEKIGIKIFDGDTAVDTDIWPSVST EKQLNKPDKYTLTPGFKADVFLSVHELLPMMFYYQLLLCEGML KTDAGNAVEKVLIDTRNAIFNLYDAFVQEKINTITDLENYLQDK PILIGHLPKQMIDLLKGHQRDMLKAVEQKKAMLIKDTERRLKL LDKQLKQETDVAAKNTGTLLKNGQIADWLVNDMMRFQPVKR DKEGNPINCSKANSTEYQMLQRAFAFYATDSCRLSRYFTQLHLI HSDNSHLFLSRFEYDKQPNLIAFYAAYLKAKLEFLNELQPQNW ASDNYFLLLRAPKNDRQKLAEGWKNGFNLPRGLFTEKIKTWFN EHKTIVDISDCDIFKNRVGQVARLIPVFFDKKFKDHSQPFYRYDF NVGNVSKPTEANYLSKGKREELFKSYQNKFKNNIPAEKTKEYR EYKNFSLWKKFERELRLIKNQDILIWLMCKNLFDEKIKPKKDIL EPRIAVSYIKLDSLQTNTSTAGSLNALAKVVPMTLAIHIDSPKPK GKAGNNEKENKEFTVYIKEEGTKLLKWGNFKTLLADRRIKGLF SYIEHDDIDLKQHPLTKRRVDLELDLYQTCRIDIFQQTLGLEAQL LDKYSDLNTDNFYQMLIGWRKKEGIPRNIKEDTDFLKDVRNAF SHNQYPDSKKIAFRRIRKFNPKELILEEEEGLGIATQMYKEVEKV VNRIKRIELFD |
| HMPREF9712_03108 [Myroides odoratimimus CCUG 10230] | 11 | MKDILTTDTTEKQNRFYSHKIADKYFFGGYFNLASNNIYEVFEE VNKRNTFGKLAKRDNGNLKNYIIHVFKDELSISDFEKRVAIFAS YFPILETVDKKSIKERNRTIDLTLSQRIRQFREMLISLVTAVDQLR NFYTHYHHSDIVIENKVLDFLNSSFVSTALHVKDKYLKTDKTKE |

TABLE 1-continued

| | | |
|---|---|---|
| (SEQ ID<br>No. 116) | | FLKETIAAELDILIEAYKKKQIEKKNTRFKANKREDILNAIYNEA<br>FWSFINDKDKDKDKETVVAKGADAYFEKNHHKSNDPDFALNIS<br>EKGIVYLLSFFLTNKEMDSLKANLTGFKGKVDRESGNSIKYMA<br>TQRIYSFHTYRGLKQKIRTSEEGVKETLLMQMIDELSKVPNVVY<br>QHLSTTQQNSFIEDWNEYYKDYEDDVETDDLSRVIHPVIRKRYE<br>DRFNYFAIRFLDEFFDFPTLRFQVHLGDYVHDRRTKQLGKVESD<br>RIIKEKVTVFARLKDINSAKASYFHSLEEQDKEELDNKWTLFPN<br>PSYDFPKEHTLQHQGEQKNAGKIGIYVKLRDTQYKEKAALEEA<br>RKSLNPKERSATKASKYDIITQIIEANDNVKSEKPLVFTGQPIAY<br>LSMNDIHSMLFSLLTDNAELKKTPEEVEAKLIDQIGKQINEILSK<br>DTDTKILKKYKDNDLKETDTDKITRDLARDKEEIEKLILEQKQR<br>ADDYNYTSSTKFNIDKSRKRKHLLFNAEKGKIGVWLANDIKRF<br>MFKESKSKWKGYQHTELQKLFAYFDTSKSDLELILSNMVMVK<br>DYPIELIDLVKKSRTLVDFLNKYLEARLEYIENVITRVKNSIGTP<br>QFKTVRKECFTFLKKSNYTVVSLDKQVERILSMPLFIERGFMDD<br>KPTMLEGKSYKQHKEKFADWFVHYKENSNYQNFYDTEVYEIT<br>TEDKREKAKVTKKIKQQQKNDVFTLMMVNYMLEEVLKLSSND<br>RLSLNELYQTKEERIVNKQVAKDTQERNKNYIWNKVVDLQLC<br>DGLVHIDNVKLKDIGNFRKYENDSRVKEFLTYQSDIVWSAYLS<br>NEVDSNKLYVIERQLDNYESIRSKELLKEVQEIECSVYNQVANK<br>ESLKQSGNENFKQYVLQGLLPIGMDVREMLILSTDVKFKKEEII<br>QLGQAGEVEQDLYSLIYIRNKFAHNQLPIKEFFDFCENNYRSISD<br>NEYYAEYYMEIFRSIKEKYAN |
| Prevotella<br>*intermedia*<br>(SEQ ID<br>No. 117) | 12 | MEDDKKTTDSIRYELKDKHFWAAFLNLARHNVYITVNHINKIL<br>EEDEINRDGYENTLENSWNEIKDINKKDRLSKLIIKHFPFLEATT<br>YRQNPTDTTKQKEEKQAEAQSLESLKKSFFVFIYKLRDLRNHYS<br>HYKHSKSLERPKFEEDLQNKMYNIFDVSIQFVKEDYKHNTDINP<br>KKDFKHLDRKRKGKFHYSFADNEGNITESGLLFFVSLFLEKKDA<br>IWVQKKLEGFKCSNKSYQKMTNEVFCRSRMLLPKLRLESTQTQ<br>DWILLDMLNELIRCPKSLYERLQGVNRKKFYVSFDPADEDYDA<br>EQEPFKNTLVRHQDRFPYFALRYFDYNEVFANLRFQIDLGTYHF<br>SIYKKLIGGQKEDRHLTHKLYGFERIQEFDKQNRPDEWKAIVKD<br>SDTFKKKEEKEEEKPYISETTPHYHLENKKIGIAFKNHNIWPSTQ<br>TELTNNKRKKYNLGTSIKAEAFLSVHELLPMMFYYLLLKTENT<br>KNDNKVGGKKETKKQGKHKIEAIIESKIKDIYALYDAFANGEIN<br>SEDELKEYLKGKDIKIVHLPKQMIAILKNEHKDMAEKAEAKQE<br>KMKLATENRLKTLDKQLKGKIQNGKRYNSAPKSGEIASWLVN<br>DMMRFQPVQKDENGESLNNSKANSTEYQLLQRTLAFFGSEHER<br>LAPYFKQTKLIESSNPHPFLNDTEWEKCSNILSFYRSYLKARKNF<br>LESLKPEDWEKNQYFLMLKEPKTNRETLVQGWKNGFNLPRGFF<br>TEPIRKWFMEHWKSIKVDDLKRVGLVAKVTPLFFSEKYKDSVQ<br>PFYNYPFNVGDVNKPKEEDFLHREERIELWDKKKDKFKGYKA<br>KKKFKEMTDKEKEEHRSYLEFQSWNKFERELRLVRNQDIVTWL<br>LCTELIDKLKIDELNIKELKKLRLKDINTDTAKKEKNNILNRVMP<br>MELPVTVYKVNKGGYIIKNKPLHTIYIKEAETKLLKQGNFKALV<br>KDRRLNGLFSFVKTPSEAESESNPISKLRVEYELGKYQNARLDII<br>EDMLALEKKLIDKYNSLDTDNFHNMLTGWLELKGEAKKARFQ<br>NDVKLLTAVRNAFSHNQYPMYDENLFGNIERFSLSSSNIIESKGL<br>DIAAKLKEEVSKAAKKIQNEEDNKKEKET |
| Capnocytophaga<br>canimorsus<br>(SEQ ID<br>No. 118) | 13 | MKNIQRLGKGNEFSPFKKEDKFYFGGFLNLANNNIEDFFKEIITR<br>FGIVITDENKKPKETFGEKILNEIFKKDISIVDYEKWVNIFADYFP<br>FTKYLSLYLEEMQFKNRVICFRDVMKELLKTVEALRNFYTHYD<br>HEPIKIEDRVFYFLDKVLLDVSLTVKNKYLKTDKTKEFLNQHIG<br>EELKELCKQRKDYLVGKGKRIDKESEIINGIYNNAFKDFICKREK<br>QDDKENHNSVEKILCNKEPQNKKQKSSATVWELCSKSSSKYTE<br>KSFPNRENDKHCLEVPISQKGIVFLLSFFLNKGEIYALTSNIKGFK<br>AKITKEEPVTYDKNSIRYMATHRMFSFLAYKGLKRKIRTSEINY<br>NEDGQASSTYEKETLMLQMLDELNKVPDVVYQNLSEDVQKTFI<br>EDWNEYLKENNGDVGTMEEEQVIHPVIRKRYEDKFNYFAIRFL<br>DEFAQFPTLRFQVHLGNYLCDKRTKQICDTTTEREVKKKITVFG<br>RLSELENKKAIFLNEREEIKGWEVFPNPSYDFPKENISVNYKDFP<br>IVGSILDREKQPVSNKIGIRVKIADELQREIDKAIKEKKLRNPKNR<br>KANQDEKQKERLVNEIVSTNSNEQGEPVVFIGQPTAYLSMNDIH<br>SVLYEFLINKISGEALETKIVEKIETQIKQIIGKDATTKILKPYTNA<br>NSNSINREKLLRDLEQEQQILKTLLEEQQQREKDKKDKKSKRK<br>HELYPSEKGKVAVWLANDIKRFMPKAFKEQWRGYHHSLLQKY<br>LAYYEQSKEELKNLLPKEVFKHFPFKLKGYFQQQYLNQFYTDY<br>LKRRLSYVNELLLNIQNFKNDKDALKATEKECFKFFRKQNYIIN<br>PINIQIQSILVYPIFLKRGFLDEKPTMIDREKFKENKDTELADWF<br>MHYKNYKEDNYQKFYAYPLEKVEEKEKFKRNKQINKQKKND<br>VYTLMMVEYIIQKIFGDKFVEENPLVLKGIFQSKAERQQNNTHA<br>ATTQERNLNGILNQPKDIKIQGKITVKGVKLKDIGNFRKYEIDQR<br>VNTFLDYEPRKEWMAYLPNDWKEKEKQGQLPPNNVIDRQISK<br>YETVRSKILLKDVQELEKIISDEIKEEHRHDLKQGKYYNFKYYIL<br>NGLLRQLKNENVENYKVFKLNTNPEKVNITQLKQEATDLEQKA<br>FVLTYIRNKFAHNQLPKKEFWDYCQEKYGKIEKEKTYAEYFAE<br>VFKREKEALIK |

TABLE 1-continued

| | | |
|---|---|---|
| *Porphyromonas gulae* (SEQ ID No. 119) | 14 | MTEQSERPYNGTYYTLEDKHFWAAFLNLARHNAYITLTHIDRQ<br>LAYSKADITNDQDVLSFKALWKNFDNDLERKSRLRSLILKHFSF<br>LEGAAYGKKLFESKSSGNKSSKNKELTKKEKEELQANALSLDN<br>LKSILFDFLQKLKDFRNYYSHYRHSGSSELPLFDGNMLQRLYNV<br>FDVSVQRVKIDHEHNDEVDPHYHFNHLVRKGKKDRYGHNDNP<br>SFKHHFVDGEGMVTEAGLLFFVSLFLEKRDAIWMQKKIRGFKG<br>GTETYQQMTNEVFCRSRISLPKLKLESLRMDDWMLLDMLNEL<br>VRCPKPLYDRLREDDRACFRVPVDILPDEDDTDGGGEDPFKNT<br>LVRHQDRFPYFALRYFDLKKVFTSLRFHIDLGTYHFAIYKKMIG<br>EQPEDRHLTRNLYGFGRIQDFAEEHRPEEWKRLVRDLDYFETG<br>DKPYISQTSPHYHIEKGKIGLRFMPEGQHLWPSPEVGTTRTGRS<br>KYAQDKRLTAEAFLSVHELMPMMFYYFLLREKYSEEVSAERV<br>QGRIKRVIEDVYAVYDAFARDEINTRDELDACLADKGIRRGHLP<br>RQMIAILSQEHKDMEEKIRKKLQEMMADTDHRLDMLDRQTDR<br>KIRIGRKNAGLPKSGVIADWLVRDMMRFQPVAKDASGKPLNNS<br>KANSTEYRMLQRALALFGGEKERLTPYFRQMNLTGGNNPHPFL<br>HETRWESHTNILSFYRSYLRARKAFLERIGRSDRVENRPFLLLKE<br>PKTDRQTLVAGWKGEFHLPRGIFTEAVRDCLIEMGHDEVASYK<br>EVGFMAKAVPLYFERACEDRVQPFYDSPFNVGNSLKPKKGRFL<br>SKEERAEEWERGKERFRDLEAWSYSAARRIEDAFAGIEYASPG<br>NKKKIEQLLRDLSLWEAFESKLKVRADRINLAKLKKEILEAQEH<br>PYHDFKSWQKFERELRLVKNQDIITWMMCRDLMEENKVEGLD<br>TGTLYLKDIRPNVQEQGSLNVLNRVKPMRLPVVVYRADSRGH<br>VHKEEAPLATVYIEERDTKLLKQGNFKSFVKDRRLNGLFSFVDT<br>GGLAMEQYPISKLRVEYELAKYQTARVCVFELTLRLEESLLTRY<br>PHLPDESFREMLESWSDPLLAKWPELHGKVRLLIAVRNAFSHN<br>QYPMYDEAVFSSIRKYDPSSPDAIEERMGLNIAHRLSEEVKQAK<br>ETVERIIQA |
| *Prevotella* sp. P5-125 (SEQ ID No. 120) | 15 | MNIPALVENQKKYFGTYSVMAMLNAQTVLDHIQKVADIEGEQ<br>NENNENLWFHPVMSHLYNAKNGYDKQPEKTMFIIERLQSYFPF<br>LKIMAENQREYSNGKYKQNRVEVNSNDIFEVLKRAFGVLKMY<br>RDLTNHYKTYEEKLNDGCEFLTSTEQPLSGMINNYYTVALRNM<br>NERYGYKTEDLAFIQDKRFKFVKDAYGKKKSQVNTGFFLSLQD<br>YNGDTQKKLHLSGVGIALLICLFLDKQYINIFLSRLPIFSSYNAQS<br>EERRIIIRSFGINSIKLPKDRIHSEKSNKSVAMDMLNEVKRCPDEL<br>FTTLSAEKQSRFRIISDDHNEVLMKRSSDRFVPLLLQYIDYGKLF<br>DHIRFHVNMGKLRYLLKADKTCIDGQTRVRVIEQPLNGFGRLE<br>EAETMRKQENGTFGNSGIRIRDFENMKRDDANPANYPYIVDTY<br>THYILENNKVEMFINDKEDSAPLLPVIEDDRYVVKTIPSCRMSTL<br>EIPAMAFHMFLFGSKKTEKLIVDVHNRYKRLFQAMQKEEVTAE<br>NIASFGIAESDLPQKILDLISGNAHGKDVDAFIRLTVDDMLTDTE<br>RRIKRFKDDRKSIRSADNKMGKRGFKQISTGKLADFLAKDIVLF<br>QPSVNDGENKITGLNYRIMQSAIAVYDSGDDYEAKQQFKLMFE<br>KARLIGKGTTEPHPFLYKVFARSIPANAVEFYERYLIERKFYLTG<br>LSNEIKKGNRVDVPFIRRDQNKWKTPAMKTLGRIYSEDLPVELP<br>RQMFDNEIKSHLKSLPQMEGIDFNNANVTYLIAEYMKRVLDDD<br>FQTFYQWNRNYRYMDMLKGEYDRKGSLQHCFTSVEEREGLW<br>KERASRTERYRKQASNKIRSNRQMRNASSEEIETILDKRLSNSR<br>NEYQKSEKVIRRYRVQDALLFLLAKKTLTELADFDGERFKLKEI<br>MPDAEKGILSEIMPMSFTFEKGGKKYTITSEGMKLKNYGDFFVL<br>ASDKRIGNLLELVGSDIVSKEDIMEEFNKYDQCRPEISSIVFNLE<br>KWAFDTYPELSARVDREEKVDFKSILKILLNNKNINKEQSDILR<br>KIRNAFDHNNYPDKGVVEIKALPEIAMSIKKAFGEYAIMK |
| *Flavobacterium branchiophilum* (SEQ ID No. 121) | 16 | MENLNKILDKENEICISKIFNTKGIAAPITEKALDNIKSKQKNDL<br>NKEARLHYFSIGHSFKQIDTKKVFDYVLIEELKDEKPLKFITLQK<br>DFFTKEFSIKLQKLINSIRNINNHYVHNFNDINLNKIDSNVFHFLK<br>ESFELAIIEKYYKVNKKYPLDNEIVLFLKELFIKDENTALLNYFT<br>NLSKDEAIEYILTFTITENKIWNINNEHNILNIEKGKYLTFEAMLF<br>LITIFLYKNEANHLLPKLYDFKNNKSKQELFTFFSKKFTSQDIDA<br>EEGHLIKFRDMIQYLNHYPTAWNNDLKLESENKNKIMTTKLIDS<br>IIEFELNSNYPSFATDIQFKKEAKAFLFASNKKRNQTSFSNKSYN<br>EEIRHNPHIKQYRDEIASALTPISFNVKEDKFKIFVKKHVLEEYFP<br>NSIGYEKFLEYNDFTEKEKEDFGLKLYSNPKTNKLIERIDNHKL<br>VKSHGRNQDRFMDFSMRFLAENNYFGKDAFFKCYKFYDTQEQ<br>DEFLQSNENNDDVKFHKGKVTTYIKYEEHLKNYSYWDCPFVEE<br>NNSMSVKISIGSEEKILKIQRNLMIYFLENALYNENVENQGYKL<br>VNNYYRELKKDVEESIASLDLIKSNPDFKSKYKKILPKRLLHNY<br>APAKQDKAPENAFETLLKKADFREEQYKKLLKKAEHEKNKED<br>FVKRNKGKQFKLHFIRKACQMMYFKEKYNTLKEGNAAFEKKD<br>PVIEKRKNKEHEFGHHKNLNITREEFNDYCKWMFAFNGNDSYK<br>KYLRDLFSEKHFFDNQEYKNLFESSVNLEAFYAKTKELFKKWIE<br>TNKPTNNENRYTLENYKNLILQKQVFINVYHFSKYLIDKNLLNS<br>ENNVIQYKSLENVEYLISDFYFQSKLSIDQYKTCGKLFNKLKSN<br>KLEDCLLYEIAYNYIDKKNVHKIDIQKILTSKIILTINDANTPYKIS<br>VPFNKLERYTEMIAIKNQNNLKARFLIDLPLYLSKNKIKKGKDS<br>AGYEIIIKNDLEIEDINTINNKIINDSVKFTEVLMELEKYFILKDKC |

TABLE 1-continued

| | | |
|---|---|---|
| | | ILSKNYIDNSEIPSLKQFSKVWIKENENEIINYRNIACHFHLPLLET<br>FDNLLLNVEQKFIKEELQNVSTINDLSKPQEYLILLFIKFKHNNF<br>YLNLFNKNESKTIKNDKEVKKNRVLQKFINQVILKKK |
| *Myroides odoratimimus* (SEQ ID No. 122) | 17 | MKDILTTDTTEKQNRFYSHKIADKYFFGGYFNLASNNIYEVFEE<br>VNKRNTFGKLAKRDNGNLKNYIIHVFKDELSISDFEKRVAIFAS<br>YFPILETVDKKSIKERNRTIDLTLSQRIRQFREMLISLVTAVDQLR<br>NFYTHYHHSDIVIENKVLDFLNSSFVSTALHVKDKYLKTDKTKE<br>FLKETIAAELDILIEAYKKKQIEKKNTRFKANKREDILNAIYNEA<br>FWSFINDKDKDKDKETVVAKGADAYFEKNHHKSNDPDFALNIS<br>EKGIVYLLSFFLTNKEMDSLKANLTGFKGKVDRESGNSIKYMA<br>TQRIYSFHTYRGLKQKIRTSEEGVKETLLMQMIDELSKVPNVVY<br>QHLSTTQQNSFIEDWNEYYKDYEDDVETDDLSRVTHPVIRKRY<br>EDRFNYFAIRFLDEFFDFPTLRFQVEILGDYVHDRRTKQLGKVES<br>DRIIKEKVTVFARLKDINSAKASYFHSLEEQDKEELDNKWTLFP<br>NPSYDFPKEHTLQHQGEQKNAGKIGIYVKLRDTQYKEKAALEE<br>ARKSLNPKERSATKASKYDIITQIIEANDNVKSEKPLVFTGQPIA<br>YLSMNDIHSMLFSLLTDNAELKKTPEEVEAKLIDQIGKQINEILS<br>KDTDTKILKKYKDNDLKETDTDKITRDLARDKEEIEKLILEQKQ<br>RADDYNYTSSTKFNIDKSRKRKHLLFNAEKGKIGVWLANDIKR<br>FMFKESKSKWKGYQHIELQKLFAYFDTSKSDLELILSNMVMVK<br>DYPIELIDLVKKSRTLVDFLNKYLEARLEYIENVITRVKNSIGTP<br>QFKTVRKECFTFLKKSNYTVVSLDKQVERILSMPLFIERGFMDD<br>KPTMLEGKSYKQHKEKFADWFVHYKENSNYQNFYDTEVYEIT<br>TEDKREKAKVTKKIKQQQKNDVFTLMMVNYMLEEVLKLSSND<br>RLSLNELYQTKEERIVNKQVAKDTQERNKNYIWNKVVDLQLC<br>DGLVHIDNVKLKDIGNFRKYENDSRVKEFLTYQSDIVWSAYLS<br>NEVDSNKLYVIERQLDNYESIRSKELLKEVQEIECSVYNQVANK<br>ESLKQSGNENFKQYVLQGLLPIGMDVREMLILSTDVKFKKEEII<br>QLGQAGEVEQDLYSLIYIRNKFAHNQLPIKEFFDFCENNYRSISD<br>NEYYAEYYMEIFRSIKEKYAN |
| *Flavobacterium columnare* (SEQ ID No. 123) | 18 | MSSKNESYNKQKTFNHYKQEDKYFFGGFLNNADDNLRQVGKE<br>FKTRINFNRNNNELASVFKDYFNKEKSVAKREHALNLLSNYFP<br>VLERIQKHTNHNFEQTREIFELLLDTIKKLRDYYTHHYHKPITIN<br>PKIYDFLDDTLLDVLITIKKKKVKNDTSRELLKEKLRPELTQLKN<br>QKREELIKKGKKLLEENLENAVFNHCLIPFLEENKTDDKQNKTV<br>SLRKYRKSKPNEETSITLTQSGLVFLMSFFLHRKEFQVFTSGLER<br>FKAKVNTIKEEEISLNKNNIVYMITHWSYSYYNFKGLKHRIKTD<br>QGVSTLEQNNTTHSLTNTNTKEALLTQIVDYLSKVPNEIYETLSE<br>KQQKEFEEDINEYMRENPENEDSTFSSIVSHKVIRKRYENKFNY<br>FAMRFLDEYAELPTLRFMVNFGDYIKDRQKKILESIQFDSERIIK<br>KEIHLFEKLSLVTEYKKNVYLKETSNIDLSRFPLFPNPSYVMAN<br>NNIPFYIDSRSNNLDEYLNQKKKAQSQNKKRNLTFEKYNKEQS<br>KDAIIAMLQKEIGVKDLQQRSTIGLLSCNELPSMLYEVIVKDIKG<br>AELENKIAQKIREQYQSIRDFTLDSPQKDNIPTTLIKTINTDSSVT<br>FENQPIDIPRLKNALQKELTLTQEKLLNVKEHEIEVDNYNRNKN<br>TYKFKNQPKNKVDDKKLQRKYVFYRNEIRQEANWLASDLIHF<br>MKNKSLWKGYMHNELQSFLAFFEDKKNDCIALLETVFNLKED<br>CILTKGLKNLFLKHGNFIDFYKEYLKLKEDFLSTESTFLENGFIG<br>LPPKILKKELSKRLKYIFIVFQKRQFIIKELEEKKNNLYADAINLS<br>RGIFDEKPTMIPFKKPNPDEFASWFVASYQYNNYQSFYELTPDI<br>VERDKKKKYKNLRAINKVKIQDYYLKLMVDTLYQDLFNQPLD<br>KSLSDFYVSKAEREKIKADAKAYQKLNDSSLWNKVIHLSLQNN<br>RITANPKLKDIGKYKRALQDEKIATLLTYDARTWTYALQKPEK<br>ENENDYKELHYTALNMELQEYEKVRSKELLKQVQELEKKILDK<br>FYDFSNNASHPEDLEIEDKKGKRHPNFKLYITKALLKNESEIINL<br>ENIDIEILLKYYDYNTEELKEKIKNMDEDEKAKIINTKENYNKIT<br>NVLIKKALVLIIIRNKMAHNQYPPKFIYDLANRFVPKKEEEYFAT<br>YFNRVFETITKELWENKEKKDKTQV |
| *Porphyromonas gingivalis* (SEQ ID No. 124) | 19 | MTEQNEKPYNGTYYTLEDKHFWAAFLNLARHNAYITLAHIDR<br>QLAYSKADITNDEDILFFKGQWKNLDNDLERKARLRSLILKHFS<br>FLEGAAYGKKLFESQSSGNKSSKKKELSKKEKEELQANALSLD<br>NLKSILFDFLQKLKDFRNYYSHYRHPESSELPLFDGNMLQRLYN<br>VFDVSVQRVKRDHEHNDKVDPHRHFNHLVRKGKKDKYGNND<br>NPFFKHHFVDREGTVTEAGLLFFVSLFLEKRDAIWMQKKIRGFK<br>GGTEAYQQMTNEVFCRSRISLPKLKLESLRTDDWMLLDMLNEL<br>VRCPKSLYDRLREEDRARFRVPVDILSDEDDTDGTEEDPFKNTL<br>VRHQDRFPYFALRYFDLKKVFTSLRFHIDLGTYHFAIYKKNIGE<br>QPEDRHLTRNLYGFGRIQDFAEEHRPEEWKRLVRDLDYFETGD<br>KPYITQTTPHYHIEKGKIGLRFVPEGQHLWPSPEVGATRTGRSK<br>YAQDKRLTAEAFLSVHELMPMMFYYFLLREKYSEEVSAEKVQ<br>GRIKRVIEDVYAVYDAFARDEINTRDELDACLADKGIRRGHLPR<br>QMIAILSQEHKDMEEKVRKKLQEMIADTDHRLDMLDRQTDRKI<br>RIGRKNAGLPKSGVVADWLVRDMMRFQPVAKDTSGKPLNNSK<br>ANSTEYRMLQRALALFGGEKERLTPYFRQMNLTGGNNPHPFLH<br>ETRWESHTNILSFYRSYLEARKAFLQSIGRSDRVENHRFLLLKEP<br>KTDRQTLVAGWKGEFHLPRGIFTEAVRDCLIEMGYDEVGSYKE<br>VGFMAKAVPLYFERASKDRVQPFYDYPFNVGNSLKPKKGRFLS |

TABLE 1-continued

| | | |
|---|---|---|
| | | KEKRAEEWESGKERFRLAKLKKEILEAKEHPYHDFKSWQKFER<br>ELRLVKNQDIITWMMCRDLMEENKVEGLDTGTLYLKDIRTDV<br>QEQGSLNVLNRVKPMRLPVVVYRADSRGHVHKEQAPLATVYI<br>EERDTKLLKQGNFKSFVKDRRLNGLFSFVDTGALAMEQYPISK<br>LRVEYELAKYQTARVCAFEQTLELEESLLTRYPHLPDKNFRKM<br>LESWSDPLLDKWPDLHGNVRLLIAVRNAFSHNQYPMYDETLFS<br>SIRKYDPSSPDAIEERMGLNIAHRLSEEVKQAKEMVERIIQA |
| *Porphyromonas* sp. COT-052 OH4946 (SEQ ID No. 125) | 20 | MTEQSERPYNGTYYTLEDKHFWAAFLNLARHNAYITLTHIDRQ<br>LAYSKADITNDQDVLSFKALWKNFDNDLERKSRLRSLILKHFSF<br>LEGAAYGKKLFESKSSGNKSSKNKELTKKEKEELQANALSLDN<br>LKSILFDFLQKLKDFRNYYSHYRHSESSELPLFDGNMLQRLYNV<br>FDVSVQRVKRDHEHNDKVDPHRHFNHLVRKGKKDRYGHNDN<br>PSFKHHFVDSEGMVTEAGLLFFVSLFLEKRDAIWMQKKIRGFK<br>GGTETYQQMTNEVFCRSRISLPKLKLESLRTDDWMLLDMLNEL<br>VRCPKPLYDRLREDDRACFRVPVDILPDEDDTDGGGEDPFKNT<br>LVRHQDRFPYFALRYFDLKKVFTSLRFHIDLGTYHFAIYKKMIG<br>EQPEDRHLTRNLYGFGRIQDFAEEHRPEEWKRLVRDLDYFETG<br>DKPYISQTTPHYHIEKGKIGLRFVPEGQHLWPSPEVGTTRTGRSK<br>YAQDKRLTAEAFLSVHELMPMMFYYFLLREKYSEEVSAEKVQ<br>GRIKRVIEDVYAIYDAFARDEINTLKELDACLADKGIRRGHLPK<br>QMIGILSQERKDMEEKVRKKLQEMIADTDHRLDMLDRQTDRKI<br>RIGRKNAGLPKSGVIADWLVRDMMRFQPVAKDTSGKPLNNSK<br>ANSTEYRMLQRALALFGGEKERLTPYFRQMNLTGGNNPHPFLH<br>ETRWESHTNILSFYRSYLRARKAFLERIGRSDRVENCPFLLLKEP<br>KTDRQTLVAGWKGEFHLPRGIFTEAVRDCLIEMGYDEVGSYRE<br>VGFMAKAVPLYFERACEDRVQPFYDSPFNVGNSLKPKKGRFLS<br>KEDRAEEWERGKERFRDLEAWSHSAARRIKDAFAGIEYASPGN<br>KKKIEQLLRDLSLWEAFESKLKVRADKINLAKLKKEILEAQEHP<br>YHDFKSWQKFERELRLVKNQDIITWMMCRDLMEENKVEGLDT<br>GTLYLKDIRPNVQEQGSLNVLNRVKPMRLPVVVYRADSRGHV<br>HKEEAPLATVYIEERDTKLLKQGNFKSFVKDRRLNGLFSFVDTG<br>GLAMEQYPISKLRVEYELAKYQTARVCVFELTLRLEESLLSRYP<br>HLPDESFREMLESWSDPLLAKWPELHGKVRLLIAVRNAFSHNQ<br>YPMYDEAVFSSIRKYDPSSPDAIEERMGLNIAHRLSEEVKQAKE<br>TVERIIQA |
| *Prevotella intermedia* (SEQ ID No. 126) | 21 | MEDDKKTKESTNMLDNKHFWAAFLNLARHNVYITVNHINKVL<br>ELKNKKDQDIIIDNDQDILAIKTHWEKVNGDLNKTERLRELMTK<br>HFPFLETAIYTKNKEDKEEVKQEKQAKAQSFDSLKHCLFLFLEK<br>LQEARNYYSHYKYSESTKEPMLEKELLKKMYNIFDDNIQLVIK<br>DYQHNKDINPDEDFKHLDRTEEEFNYYFTTNKKGNITASGLLFF<br>VSLFLEKKDAIWMQQKLRGFKDNRESKKKMTHEVFCRSRMLL<br>PKLRLESTQTQDWILLDMLNELIRCPKSLYERLQGEYRKKFNVP<br>FDSADEDYDAEQEPFKNTLVRHQDRFPYFALRYFDYNEIFTNLR<br>FQIDLGTYHFSIYKKLIGGQKEDRHLTHKLYGFERIQEFAKQNR<br>TDEWKAIVKDFDTYETSEEPYISETAPHYHLENQKIGIRFRNDN<br>DEIWPSLKTNGENNEKRKYKLDKQYQAEAFLSVHELLPMMFY<br>YLLLKKEEPNNDKKNASIVEGFIKREIRDIYKLYDAFANGEINNI<br>DDLEKYCEDKGIPKRHLPKQMVAILYDEHKDMAEEAKRKQKE<br>MVKDTKKLLATLEKQTQGEIEDGGRNIRLLKSGEIARWLVNDM<br>MRFQPVQKDNEGNPLNNSKANSTEYQMLQRSLALYNKEEKPT<br>RYFRQVNLINSSNPHPFLKWTKWEECNNILSFYRSYLTKKIEFLN<br>KLKPEDWEKNQYFLKLKEPKTNRETLVQGWKNGFNLPRGIFTE<br>PIREWFKRHQNDSEEYEKVETLDRVGLVTKVIPLFFKKEDSKDK<br>EEYLKKDAQKEINNCVQPFYGFPYNVGNIHKPDEKDFLPSEERK<br>KLWGDKKYKFKGYKAKVKSKKLTDKEKEEYRSYLEFQSWNK<br>FERELRLVRNQDIVTWLLCTELIDKLKVEGLNVEELKKLRLKDI<br>DTDTAKQEKNNILNRVMPMQLPVTVYEIDDSHNIVKDRPLHTV<br>YIEETKTKLLKQGNFKALVKDRRLNGLFSFVDTSSETELKSNPIS<br>KSLVEYELGEYQNARIETIKDMLLLEETLIEKYKTLPTDNFSDM<br>LNGWLEGKDEADKARFQNDVKLLVAVRNAFSHNQYPMRNRIA<br>FANINPFSLSSADTSEEKKLDIANQLKDKTHKIIKRIIEIEKPIETK<br>E |
| PIN17_0200 [*Prevotella intermedia* 17] (SEQ ID No. 127) | AFJ07523 | MKMEDDKKTKESTNMLDNKHFWAAFLNLARHNVYITVNHIN<br>KVLELKNKKDQDIIIDNDQDILAIKTHWEKVNGDLNKTERLREL<br>MTKHFPFLETAIYTKNKEDKEEVKQEKQAKAQSFDSLKHCLFL<br>FLEKLQEARNYYSHYKYSESTKEPMLEKELLKKMYNIFDDNIQ<br>LVIKDYQHNKDINPDEDFKHLDRTEEEFNYYFTTNKKGNITASG<br>LLFFVSLFLEKKDAIWMQQKLRGFKDNRESKKKMTHEVFCRSR<br>MLLPKLRLESTQTQDWILLDMLNELIRCPKSLYERLQGEYRKKF<br>NVPFDSADEDYDAEQEPFKNTLVRHQDRFPYFALRYFDYNEIFT<br>NLRFQIDLGTYHFSIYKKLIGGQKEDRHLTHKLYGFERIQEFAK<br>QNRTDEWKAIVKDFDTYETSEEPYISETAPHYHLENQKIGIRFRN<br>DNDEIWPSLKTNGENNEKRKYKLDKQYQAEAFLSVHELLPMM<br>FYYLLLKKEEPNNDKKNASIVEGFIKREIRDIYKLYDAFANGEIN<br>NIDDLEKYCEDKGIPKRHLPKQMVAILYDEHKDMAEEAKRKQ<br>KEMVKDTKKLLATLEKQTQGEIEDGGRNIRLLKSGEIARWLVN<br>DMMRFQPVQKDNEGNPLNNSKANSTEYQMLQRSLALYNKEEK |

TABLE 1-continued

| | | |
|---|---|---|
| | | PTRYFRQVNLINSSNPHPFLKWTKWEECNNILSFYRSYLTKKIEF<br>LNKLKPEDWEKNQYFLKLKEPKTNRETLVQGWKNGFNLPRGIF<br>TEPIREWFKRHQNDSEEYEKVETLDRVGLVTKVIPLFFKKEDSK<br>DKEEYLKKDAQKEINNCVQPFYGFPYNVGNIHKPDEKDFLPSEE<br>RKKLWGDKKYKFKGYKAKVKSKKLTDKEKEEYRSYLEFQSW<br>NKFERELRLVRNQDIVTWLLCTELIDKLKVEGLNVEELKKLRLK<br>DIDTDTAKQEKNNILNRVMPMQLPVTVYEIDDSHNIVKDRPLHT<br>VYIEETKTKLLKQGNFKALVKDRRLNGLFSFVDTSSETELKSNPI<br>SKSLVEYELGEYQNARIETIKDMLLLEETLIEKYKTLPTDNFSDM<br>LNGWLEGKDEADKARFQNDVKLLVAVRNAFSHNQYPMRNRIA<br>FANINPFSLSSADTSEEKKLDIANQLKDKTHKIIKRIIEIEKPIETK<br>E |
| *Prevotella*<br>*intermedia*<br>(SEQ ID<br>No. 128) | BAU18623 | MEDDKKTTDSISYELKDKHFWAAFLNLARHNVYITVNHINKVL<br>ELKNKKDQDIIIDNDQDILAIKTHWEKVNGDLNKTERLRELMTK<br>HFPFLETAIYSKNKEDKEEVKQEKQAKAQSFDSLKHCLFLFLEK<br>LQETRNYYSHYKYSESTKEPMLEKELLKKMYNIFDDNIQLVIKD<br>YQHNKDINPDEDFKHLDRTEEDFNYYFTRNKKGNITESGLLFFV<br>SLFLEKKDAIWMQQKLRGFKDNRESKKKMTHEVFCRSRMLLP<br>KLRLESTQTQDWILLDMLNELIRCPKSLYERLQGEDREKFKVPF<br>DPADEDYDAEQEPFKNTLVRHQDRFPYFALRYFDYNEIFTNLRF<br>QIDLGTFHFSIYKKLIGGQKEDRHLTHKLYGFERIQEFAKQNRPD<br>EWKAIVKDLDTYETSNERYISETTPHYHLENQKIGIRFRNDNDEI<br>WPSLKTNGENNEKSKYKLDKQYQAEAFLSVHELLPMMFYYLL<br>LKKEEPNNDKKNASIVEGFIKREIRDMYKLYDAFANGEINNIDD<br>LEKYCEDKGIPKRHLPKQMVAILYDEHKDMVKEAKRKQRKMV<br>KDTEKLLAALEKQTQEKTEDGGRNIRLLKSGEIARWLVNDMM<br>RFQPVQKDNEGNPLNNSKANSTEYQMLQRSLALYNKEEKPTRY<br>FRQVNLINSSNPHPFLKWTKWEECNNILSFYRSYLTKKIEFLNKL<br>KPEDWEKNQYFLKLKEPKTNRETLVQGWKNGFNLPRGIFTEPIR<br>EWFKRHQNDSKEYEKVEALDRVGLVTKVIPLFFKKEDSKDKEE<br>DLKKDAQKEINNCVQPFYSFPYNVGNIHKPDEKDFLHREERIEL<br>WDKKKDKFKGYKAKVKSKKLTDKEKEEYRSYLEFQSWNKFER<br>ELRLVRNQDIVTWLLCTELIDKLKVEGLNVEELKKLRLKDIDTD<br>TAKQEKNNILNRVMPMQLPVTVYEIDDSHNIVKDRPLHTVYIEE<br>TKTKLLKQGNFKALVKDRRLNGLFSFVDTSSEAELKSNPISKSL<br>VEYELGEYQNARIETIKDMLLLEETLIEKYKNLPTDNFSDMLNG<br>WLEGKDEADKARFQNDVKLLVAVRNAFSHNQYPMRNRIAFAN<br>INPFSLSSADTSEEKKLDIANQLKDKTHKIIKRIIEIEKPIETKE |
| HMPREF6485_0083<br>[*Prevotella*<br>*buccae*<br>ATCC<br>33574]<br>(SEQ ID<br>No. 129) | EFU31981 | MQKQDKLFVDRKKNAIFAFPKYITIMENKEKPEPIYYELTDKHF<br>WAAFLNLARHNVYTTINHINRRLEIAELKDDGYMMGIKGSWNE<br>QAKKLDKKVRLRDLIMKHFPFLEAAAYEMTNSKSPNNKEQRE<br>KEQSEALSLNNLKNVLFIFLEKLQVLRNYYSHYKYSEESPKPIFE<br>TSLLKNMYKVFDANVRLVKRDYMHHENIDMQRDFTHLNRKK<br>QVGRTKNIIDSPNFHYHFADKEGNMTIAGLLFFVSLFLDKKDAI<br>WMQKKLKGFKDGRNLREQMTNEVFCRSRISLPKLKLENVQTK<br>DWMQLDMLNELVRCPKSLYERLREKDRESFKVPFDIFSDDYNA<br>EEEPFKNTLVRHQDRFPYFVLRYFDLNEIFEQLRFQIDLGTYHFS<br>IYNKRIGDEDEVRHLTHHLYGFARIQDFAPQNQPEEWRKLVKD<br>LDHFETSQEPYISKTAPHYHLENEKIGIKFCSAHNNLFPSLQTDK<br>TCNGRSKFNLGTQFTAEAFLSVHELLPMMFYYLLLTKDYSRKE<br>SADKVEGIIRKEISNIYAIYDAFANNEINSIADLTRRLQNTNILQG<br>HLPKQMISILKGRQKDMGKEAERKIGEMIDDTQRRLDLLCKQT<br>NQKIRIGKRNAGLLKSGKIADWLVNDMMRFQPVQKDQNNIPIN<br>NSKANSTEYRMLQRALALFGSENFRLKAYFNQMNLVGNDNPH<br>PFLAETQWEHQTNILSFYRNYLEARKKYLKGLKPQNWKQYQH<br>FLILKVQKTNRNTLVTGWKNSFNLPRGIFTQPIREWFEKHNNSK<br>RIYDQILSFDRVGFVAKAIPLYFAEEYKDNVQPFYDYPFNIGNRL<br>KPKKRQFLDKKERVELWQKNKELFKNYPSEKKKTDLAYLDFLS<br>WKKFERELRLIKNQDIVTWLMFKELFNMATVEGLKIGEIHLRDI<br>DTNTANEESNNILNRIMPMKLPVKTYETDNKGNILKERPLATFY<br>IEETETKVLKQGNFKALVKDRRLNGLFSFAETTDLNLEEHPISKL<br>SVDLELIKYQTTRISIFEMTLGLEKKLIDKYSTLPTDSFRNMLER<br>WLQCKANRPELKNYVNSLIAVRNAFSHNQYPMYDATLFAEVK<br>KFTLFPSVDTKKIELNIAPQLLEIVGKAIKEIEKSENKN |
| HMPREF9144_1146<br>[*Prevotella*<br>*pallens*<br>ATCC<br>700821]<br>(SEQ ID<br>No. 130) | EGQ18444 | MKEEEKGKTPVVSTYNKDDKHFWAAFLNLARHNVYITVNHIN<br>KILGEGEINRDGYENTLEKSWNEIKDINKKDRLSKLIIKHFPFLE<br>VTTYQRNSADTTKQKEEKQAEAQSLESLKKSFFVFIYKLRDLRN<br>HYSHYKHSKSLERPKFEEDLQEKMYNIFDASIQLVKEDYKHNT<br>DIKTEEDFKHLDRKGQFKYSFADNEGNITESGLLFFVSLFLEKK<br>DAIWVQKKLEGFKCSNESYQKMTNEVFCRSRMLLPKLRLQSTQ<br>TQDWILLDMLNELIRCPKSLYERLREEDRKKFRVPIEIADEDYD<br>AEQEPFKNALVRHQDRFPYFALRYFDYNEIFTNLRFQIDLGTYH<br>FSIYKKQIGDYKESHHLTHKLYGFERIQEFTKQNRPDEWRKFVK<br>TFNSFETSKEPYIPETTPHYHLENQKIGIRFRNDNDKIWPSLKTNS<br>EKNEKSKYKLDKSFQAEAFLSVHELLPMMFYYLLLKTENTDND<br>NEIETKKKENKNDKQEKHKIEEIIENKITEIYALYDAFANGKINSI<br>DKLEEYCKGKDIEIGHLPKQMIAILKSEHKDMATEAKRKQEEM |

TABLE 1-continued

| | | |
|---|---|---|
| | | LADVQKSLESLDNQINEEIENVERKNSSLKSGEIASWLVNDMM<br>RFQPVQKDNEGNPLNNSKANSTEYQMLQRSLALYNKEEKPTRY<br>FRQVNLIESSNPHPFLNNTEWEKCNNILSFYRSYLEAKKNFLESL<br>KPEDWEKNQYFLMLKEPKTNCETLVQGWKNGFNLPRGIFTEPI<br>RKWFMEHRKNITVAELKRVGLVAKVIPLFFSEEYKDSVQPFYN<br>YLFNVGNINKPDEKNFLNCEERRELLRKKKDEFKKMTDKEKEE<br>NPSYLEFQSWNKFERELRLVRNQDIVTWLLCMELFNKKKIKEL<br>NVEKIYLKNINTNTTKKEKNTEEKNGEEKIIKEKNNILNRIMPMR<br>LPIKVYGRENFSKNKKKKIRRNTFFTVYIEEKGTKLLKQGNFKA<br>LERDRRLGGLFSFVKTHSKAESKSNTISKSRVEYELGEYQKARIE<br>IIKDMLALEETLIDKYNSLDTDNFHNMLTGWLKLKDEPDKASF<br>QNDVDLLIAVRNAFSHNQYPMRNRIAFANINPFSLSSANTSEEK<br>GLGIANQLKDKTHKTIEKIIEIEKPIETKE |
| HMPREF9714_02132<br>[Myroides<br>odoratimimus<br>CCUG<br>12901]<br>(SEQ ID<br>No. 131) | EHO08761 | MKDILTTDTTEKQNRFYSHKIADKYFFGGYFNLASNNIYEVFEE<br>VNKRNTFGKLAKRDNGNLKNYIIHVFKDELSISDFEKRVAIFAS<br>YFPILETVDKKSIKERNRTIDLTLSQRIRQFREMLISLVTAVDQLR<br>NFYTHYHHSEIVIENKVLDFLNSSLVSTALHVKDKYLKTDKTKE<br>FLKETIAAELDILIEAYKKKQIEKKNTRFKANKREDILNAIYNEA<br>FWSFINDKDKDKETVVAKGADAYFEKNHHKSNDPDFALNISEK<br>GIVYLLSFFLTNKEMDSLKANLTGFKGKVDRESGNSIKYMATQ<br>RIYSFHTYRGLKQKIRTSEEGVKETLLMQMIDELSKVPNVVYQH<br>LSTTQQNSFIEDWNEYYKDYEDDVETDDLSRVIHPVIRKRYEDR<br>FNYFAIRFLDEFFDFPTLRFQVHLGDYVHDRRTKQLGKVESDRII<br>KEKVTVFARLKDINSAKANYFHSLEEQDKEELDNKWTLFPNPS<br>YDFPKEHTLQHQGEQKNAGKIGIYVKLRDTQYKEKAALEEARK<br>SLNPKERSATKASKYDIITQIIEANDNVKSEKPLVFTGQPIAYLS<br>MNDIHSMLFSLLTDNAELKKTPEEVEAKLIDQIGKQINEILSKDT<br>DTKILKKYKDNDLKETDTDKITRDLARDKEEIEKLILEQKQRAD<br>DYNYTSSTKFNIDKSRKRKHLLFNAEKGKIGVWLANDIKRFMT<br>EEFKSKWKGYQHTELQKLFAYYDTSKSDLDLILSDMVMVKDY<br>PIELIALVKKSRTLVDFLNKYLEARLGYMENVITRVKNSIGTPQF<br>KTVRKECFTFLKKSNYTVVSLDKQVERILSMPLFIERGFMDDKP<br>TMLEGKSYQQHKEKFADWFVHYKENSNYQNFYDTEVYEITTE<br>DKREKAKVTKKIKQQQKNDVFTLMMVNYMLEEVLKLSSNDRL<br>SLNELYQTKEERIVNKQVAKDTQERNKNYIWNKVVDLQLCEG<br>LVRIDKVKLKDIGNFRKYENDSRVKEFLTYQSDIVWSAYLSNEV<br>DSNKLYVIERQLDNYESIRSKELLKEVQEIECSVYNQVANKESL<br>KQSGNENFKQYVLQGLVPIGMDVREMLILSTDVKFIKEEIIQLG<br>QAGEVEQDLYSLIYIRNKFAHNQLPIKEFFDFCENNYRSISDNEY<br>YAEYYMEIFRSIKEKYTS |
| HMPREF9711_00870<br>[Myroides<br>odoratimimus<br>CCUG<br>3837]<br>(SEQ ID<br>No. 132) | EKB06014 | MKDILTTDTTEKQNRFYSHKIADKYFFGGYFNLASNNIYEVFEE<br>VNKRNTFGKLAKRDNGNLKNYIIHVFKDELSISDFEKRVAIFAS<br>YFPILETVDKKSIKERNRTIDLTLSQRIRQFREMLISLVTAVDQLR<br>NFYTHYHHSEIVIENKVLDFLNSSLVSTALHVKDKYLKTDKTKE<br>FLKETIAAELDILIEAYKKKQIEKKNTRFKANKREDILNAIYNEA<br>FWSFINDKDKDKETVVAKGADAYFEKNHHKSNDPDFALNISEK<br>GIVYLLSFFLTNKEMDSLKANLTGFKGKVDRESGNSIKYMATQ<br>RIYSFHTYRGLKQKIRTSEEGVKETLLMQMIDELSKVPNVVYQH<br>LSTTQQNSFIEDWNEYYKDYEDDVETDDLSRVIHPVIRKRYEDR<br>FNYFAIRFLDEFFDFPTLRFQVHLGDYVHDRRTKQLGKVESDRII<br>KEKVTVFARLKDINSAKASYFHSLEEQDKEELDNKWTLFPNPS<br>YDFPKEHTLQHQGEQKNAGKIGIYVKLRDTQYKEKAALEEARK<br>SLNPKERSATKASKYDIITQIIEANDNVKSEKPLVFTGQPIAYLS<br>MNDIHSMLFSLLTDNAELKKTPEEVEAKLIDQIGKQINEILSKDT<br>DTKILKKYKDNDLKETDTDKITRDLARDKEEIEKLILEQKQRAD<br>DYNYTSSTKFNIDKSRKRKHLLFNAEKGKIGVWLANDIKRFMF<br>KESKSKWKGYQHTELQKLFAYFDTSKSDLELILSDMVMVKDYP<br>IELIDLVRKSRTLVDFLNKYLEARLGYIENVITRVKNSIGTPQFKT<br>VRKECFAFLKESNYTVASLDKQIERILSMPLFIERGFMDSKPTML<br>EGKSYQQHKEDFADWFVHYKENSNYQNFYDTEVYEIITEDKRE<br>QAKVTKKIKQQQKNDVFTLMMVNYMLEEVLKLPSNDRLSLNE<br>LYQTKEERIVNKQVAKDTQERNKNYIWNKVVDLQLCEGLVRID<br>KVKLKDIGNFRKYENDSRVKEFLTYQSDIVWSGYLSNEVDSNK<br>LYVIERQLDNYESIRSKELLKEVQEIECIVYNQVANKESLKQSGN<br>ENFKQYVLQGLLPRGTDVREMLILSTDVKFKKEEIMQLGQVRE<br>VEQDLYSLIYIRNKFAHNQLPIKEFFDFCENNYRPISDNEYYAEY<br>YMEIFRSIKEKYAS |
| HMPREF9699_02005<br>[*Bergeyella<br>zoohelcum*<br>ATCC<br>43767]<br>(SEQ ID<br>No. 133) | EKB54193 | MENKTSLGNNIYYNPFKPQDKSYFAGYFNAAMENTDSVFRELG<br>KRLKGKEYTSENFFDAIFKENISLVEYERYVKLLSDYFPMARLL<br>DKKEVPIKERKENFKKNFKGIIKAVRDLRNFYTHKEHGEVEITD<br>EIFGVLDEMLKSTVLTVKKKKVKTDKTKEILKKSIEKQLDILCQ<br>KKLEYLRDTARKIEEKRRNQRERGEKELVAPFKYSDKRDDLIA<br>AIYNDAFDVYIDKKKDSLKESSKAKYNTKSDPQQEEGDLKIPIS<br>KNGVVFLLSLFLTKQEIHAFKSKIAGFKATVIDEATVSEATVSHG<br>KNSICFMATHEIFSHLAYKKLKRKVRTAEINYGEAENAEQLSVY<br>AKETLMMQMLDELSKVPDVVYQNLSEDVQKTFIEDWNEYLKE<br>NNGDVGTMEEEQVIHPVIRKRYEDKFNYFAIRFLDEFAQFPTLR |

TABLE 1-continued

| | | |
|---|---|---|
| | | FQVHLGNYLHDSRPKENLISDRRIKEKITVFGRLSELEHKKALFI<br>KNTETNEDREHYWEIFPNPNYDFPKENISVNDKDFPIAGSILDRE<br>KQPVAGKIGIKVKLLNQQYVSEVDKAVKAHQLKQRKASKPSIQ<br>NIIEEIVPINESNPKEAIVFGGQPTAYLSMNDIHSILYEFFDKWEK<br>KKEKLEKKGEKELRKEIGKELEKKIVGKIQAQIQQIIDKDTNAKI<br>LKPYQDGNSTAIDKEKLIKDLKQEQNILQKLKDEQTVREKEYN<br>DFIAYQDKNREINKVRDRNHKQYLKDNLKRKYPEAPARKEVL<br>YYREKGKVAVWLANDIKRFMPTDFKNEWKGEQHSLLQKSLAY<br>YEQCKEELKNLLPEKVFQHLPFKLGGYFQQKYLYQFYTCYLDK<br>RLEYISGLVQQAENFKSENKVFKKVENECFKFLKKQNYTHKEL<br>DARVQSILGYPIFLERGFMDEKPTIIKGKTFKGNEALFADWFRY<br>YKEYQNFQTFYDTENYPLVELEKKQADRKRKTKIYQQKKNDV<br>FTLLMAKHIFKSVFKQDSIDQFSLEDLYQSREERLGNQERARQT<br>GERNTNYIWNKTVDLKLCDGKITVENVKLKNVGDFIKYEYDQR<br>VQAFLKYEENIEWQAFLIKESKEEENYPYVVEREIEQYEKVRRE<br>ELLKEVHLIEEYILEKVKDKEILKKGDNQNFKYYILNGLLKQLK<br>NEDVESYKVFNLNTEPEDVNINQLKQEATDLEQKAFVLTYIRN<br>KFAHNQLPKKEFWDYCQEKYGKIEKEKTYAEYFAEVFKKEKE<br>ALIK |
| HMPREF9151_01387<br>[*Prevotella*<br>*saccharolytica*<br>F0055]<br>(SEQ ID<br>No. 134) | EKY00089 | MMEKENVQGSHIYYEPTDKCFWAAFYNLARHNAYLTIAHINSF<br>VNSKKGINNDDKVLDIIDDWSKFDNDLLMGARLNKLILKHFPFL<br>KAPLYQLAKRKTRKQQGKEQQDYEKKGDEDPEVIQEAIANAFK<br>MANVRKTLHAFLKQLEDLRNHFSHYNYNSPAKKMEVKFDDGF<br>CNKLYYVFDAALQMVKDDNRMNPEINMQTDFEHLVRLGRNR<br>KIPNTFKYNFTNSDGTINNNGLLFFVSLFLEKRDAIWMQKKIKG<br>FKGGTENYMRMTNEVFCRNRMVIPKLRLETDYDNHQLMFDML<br>NELVRCPLSLYKRLKQEDQDKFRVPIEFLDEDNEADNPYQENA<br>NSDENPTEETDPLKNTLVRHQHRFPYFVLRYFDLNEVFKQLRFQ<br>INLGCYHFSIYDKTIGERTEKRHLTRTLFGFDRLQNFSVKLQPEH<br>WKNMVKHLDTEESSDKPYLSDAMPHYQIENEKIGIHFLKTDTE<br>KKETVWPSLEVEEVSSNRNKYKSEKNLTADAFLSTHELLPMMF<br>YYQLLSSEEKTRAAAGDKVQGVLQSYRKKIFDIYDDFANGTINS<br>MQKLDERLAKDNLLRGNMPQQMLAILEHQEPDMEQKAKEKL<br>DRLITETKKRIGKLEDQFKQKVRIGKRRADLPKVGSIADWLVND<br>MMRFQPAKRNADNTGVPDSKANSTEYRLLQEALAFYSAYKDR<br>LEPYFRQVNLIGGTNPHPFLHRVDWKKCNHLLSFYHDYLEAKE<br>QYLSHLSPADWQKHQHFLLLKVRKDIQNEKKDWKKSLVAGW<br>KNGFNLPRGLFTESIKTWFSTDADKVQITDTKLFENRVGLIAKLI<br>PLYYDKVYNDKPQPFYQYPFNINDRYKPEDTRKRFTAASSKLW<br>NEKKMLYKNAQPDSSDKIEYPQYLDFLSWKKLERELRMLRNQ<br>DMMVWLMCKDLFAQCTVEGVEFADLKLSQLEVDVNVQDNLN<br>VLNNVSSMILPLSVYPSDAQGNVLRNSKPLHTVYVQENNTKLL<br>KQGNFKSLLKDRRLNGLFSFIAAEGEDLQQHPLTKNRLEYELSI<br>YQTMRISVFEQTLQLEKAILTRNKTLCGNNFNNLLNSWSEHRTD<br>KKTLQPDIDFLIAVRNAFSHNQYPMSTNTVMQGIEKFNIQTPKL<br>EEKDGLGIASQLAKKTKDAASRLQNIINGGTN |
| A343_1752<br>[*Porphyromonas*<br>*gingivalis*<br>JCVI<br>SC001]<br>(SEQ ID<br>No. 135) | EOA10535 | MTEQNEKPYNGTYYTLEDKHFWAAFFNLARHNAYITLTHIDRQ<br>LAYSKADITNDEDILFFKGQWKNLDNDLERKARLRSLILKHFSF<br>LEGAAYGKKLFESQSSGNKSSKKKELTKKEKEELQANALSLDN<br>LKSILFDFLQKLKDFRNYYSHYRHPESSELPLFDGNMLQRLYNV<br>FDVSVQRVKRDHEHNDKVDPHRHFNHLVRKGKKDRCGNNDN<br>PFFKHHFVDREEKVTEAGLLFFVSLFLEKRDAIWMQKKIRGFKG<br>GTETYQQMTNEVFCRSRISLPKLKLESLRTDDWMLLDMLNELV<br>RCPKSLYDRLREEDRARFRVPVDILSDEDDTDGTEEDPFKNTLV<br>RHQDRFPYFALRYFDLKKVFTSLRFHIDLGTYHFAIYKKNIGEQ<br>PEDRHLTRNLYGFGRIQDFAEEHRPEEWKRLVRDLDYFETGDK<br>PYITQTTPHYHIEKGKIGLRFVPEGQLLWPSPEVGATRTGRSKY<br>AQDKRFTAEAFLSVHELMPMMFYYFLLREKYSEEASAERVQGR<br>IKRVIEDVYAVYDAFARGEIDTLDRLDACLADKGIRRGHLPRQ<br>MIAILSQEHKDMEEKVRKKLQEMIADTDHRLDMLDRQTDRKIR<br>IGRKNAGLPKSGVIADWLVRDMMRFQPVAKDTSGKPLNNSKA<br>NSTEYRMLQRALALFGGEKERLTPYFRQMNLTGGNNPETPFLHE<br>TRWESHTNILSFYRSYLKARKAFLQSIGRSDRVENHRFLLLKEP<br>KTDRQTLVAGWKGEFHLPRGIFTEAVRDCLIEMGLDEVGSYKE<br>VGFMAKAVPLYFERACKDRVQPFYDYPFNVGNSLKPKKGRFLS<br>KEKRAEEWESGKERFRDLEAWSHSAARRIEDAFAGIENASREN<br>KKKIEQLLQDLSLWETFESKLKVKADKINIAKLKKEILEAKEHP<br>YLDFKSWQKFERELRLVKNQDIITWMMCRDLMEENKVEGLDT<br>GTLYLKDIRTDVHEQGSLNVLNRVKPMRLPVVVYRADSRGHV<br>HKEQAPLATVYIEERDTKLLICQGNFKSFVKDRRLNGLFSFVDT<br>GALAMEQYPISKLRVEYELAKYQTARVCAFEQTLELEESLLTRY<br>PHLPDKNFRKMLESWSDPLLDKWPDLHGNVRLLIAVRNAFSHN<br>QYPMYDETLFSSIRKYDPSSPDAIEERMGLNIAHRLSEEVKQAK<br>EMVERIIQA |
| HMPREF1981_03090<br>[*Bacteroides*<br>*pyogenes* | ERI81700 | MESIKNSQKSTGKTLQKDPPYFGLYLNMALLNVRKVENHIRKW<br>LGDVALLPEKSGFHSLLTTDNLSSAKWTRFYYKSRKFLPFLEMF<br>DSDKKSYENRRETTECLDTIDRQKISSLLKEVYGKLQDIRNAFS |

TABLE 1-continued

| | | |
|---|---|---|
| F0041] (SEQ ID No. 136) | | HYHIDDQSVKHTALIISSEMHRFIENAYSFALQKTRARFTGVFVE TDFLQAEEKGDNKKFFAIGGNEGIKLKDNALIFLICLFLDREEAF KFLSRATGFKSTKEKGFLAVRETFCALCCRQPHERLLSVNPREA LLMDMLNELNRCPDILFEMLDEKDQKSFLPLLGEEEQAHILENS LNDELCEAIDDPFEMIASLSKRVRYKNRFPYLMLRYIEEKNLLPF IRFRIDLGCLELASYPKKMGEENNYERSVTDHAMAFGRLTDFH NEDAVLQQITKGITDEVRFSLYAPRYAIYNNKIGFVRTGGSDKIS FPTLKKKGGEGHCVAYTLQNTKSFGFISIYDLRKILLLSFLDKDK AKNIVSGLLEQCEKHWKDLSENLFDAIRTELQKEFPVPLIRYTLP RSKGGKLVSSKLADKQEKYESEFERRKEKLTEILSEKDFDLSQIP RRMIDEWLNVLPTSREKKLKGYVETLKLDCRERLRVFEKREKG EHPVPPRIGEMATDLAKDIIRMVIDQGVKQRITSAYYSEIQRCLA QYAGDDNRRHLDSIIRELRLKDTKNGHPFLGKVLRPGLGHTEK LYQRYFEEKKEWLEATFYPAASPKRVPRFVNPPTGKQKELPLII RNLMKERPEWRDWKQRKNSHPIDLPSQLFENEICRLLKDKIGKE PSGKLKWNEMFKLYWDKEFPNGMQRFYRCKRRVEVFDKVVE YEYSEEGGNYKKYYEALIDEVVRQKISSSKEKSKLQVEDLTLSV RRVFKRAINEKEYQLRLLCEDDRLLFMAVRDLYDWKEAQLDL DKIDNMLGEPVSVSQVIQLEGGQPDAVIKAECKLKDVSKLMRY CYDGRVKGLMPYFANHEATQEQVEMELRHYEDHRRRVFNWV FALEKSVLKNEKLRRFYEESQGGCEHRRCIDALRKASLVSEEEY EFLVHIRNKSAHNQFPDLEIGKLPPNVTSGFCECIWSKYKAIICRI IPFIDPERRFFGKLLEQK |
| HMPREF1553_02065 [*Porphyromonas gingivalis* F0568] (SEQ ID No. 137) | ERJ65637 | MNTVPASENKGQSRTVEDDPQYFGLYLNLARENLIEVESHVRIK FGKKKLNEESLKQSLLCDHLLSVDRWTKVYGHSRRYLPFLHYF DPDSQIEKDHDSKTGVDPDSAQRLIRELYSLLDFLRNDFSHNRL DGTTFEHLEVSPDISSFITGTYSLACGRAQSRFADFFKPDDFVLA KNRKEQLISVADGKECLTVSGLAFFICLFLDREQASGMLSRIRGF KRTDENWARAVHETFCDLCIRHPHDRLESSNTKEALLLDMLNE LNRCPRILYDMLPEEERAQFLPALDENSMNNLSENSLNEESRLL WDGSSDWAEALTKRIRHQDRFPYLMLRFIEEMDLLKGIRFRVD LGEIELDSYSKKVGRNGEYDRTITDHALAFGKLSDFQNEEEVSR MISGEASYPVRFSLFAPRYAIYDNKIGYCHTSDPVYPKSKTGEK RALSNPRSMGFISVHDLRKLLLMELLCEGSFSRMQSDFLRKANR ILDETAEGKLQFSALFPEMRHRFIPPQNPKSKDRREKAETTLEKY KQEIKGRKDKLNSQLLSAFDMDQRQLPSRLLDEWMNIRPASHS VKLRTYVKQLNEDCRLRLQKFRKDGDGKARAIPLVGEMATFLS QDIVRMIISEETKKLITSAYYNEMQRSLAQYAGEENRHQFRAIV AELRLLDPSSGHPFLSATMETAHRYTEDFYKCYLEKKREWLAK TFYRPEQDENTKRRISVFFVPDGEARKLLPLLIRRRMKEQNDLQ DWIRNKQAHPIDLPSHLFDSKIMELLKVKDGKKKWNEAFKDW WSTKYPDGMQPFYGLRRELNIHGKSVSYIPSDGKKFADCYTHL MEKTVQDKKRELRTAGKPVPPDLAADIKRSFHRAVNEREFMLR LVQEDDRLMLMAINKMMTDREEDILPGLKNIDSILDEENQFSLA VHAKVLEKEGEGGDNSLSLVPATIEIKSKRKDWSKYIRYRYDR RVPGLMSHFPEHKATLDEVKTLLGEYDRCRIKIFDWAFALEGAI MSDRDLKPYLHESSSREGKSGEHSTLVKMLVEKKGCLTPDESQ YLILIRNKAAHNQFPCAAEMPLIYRDVSAKVGSIEGSSAKDLPE GSSLVDSLWKKYEMIIRKILPILDPENRFFGKLLNNMSQPINDL |
| HMPREF1988_01768 [*Porphyromonas gingivalis* F0185] (SEQ ID No. 138) | ERJ81987 | MNTVPASENKGQSRTVEDDPQYFGLYLNLARENLIEVESHVRIK FGKKKLNEESLKQSLLCDHLLSVDRWTKVYGHSRRYLPFLHYF DPDSQIEKDHDSKTGVDPDSAQRLIRELYSLLDFLRNDFSHNRL DGTTFEHLEVSPDISSFITGTYSLACGRAQSRFADFFKPDDFVLA KNRKEQLISVADGKECLTVSGLAFFICLFLDREQASGMLSRIRGF KRTDENWARAVHETFCDLCIRHPHDRLESSNTKEALLLDMLNE LNRCPRILYDMLPEEERAQFLPALDENSMNNLSENSLNEESRLL WDGSSDWAEALTKRIRHQDRFPYLMLRFIEEMDLLKGIRFRVD LGEIELDSYSKKVGRNGEYDRTITDHALAFGKLSDFQNEEEVSR MISGEASYPVRFSLFAPRYAIYDNKIGYCHTSDPVYPKSKTGEK RALSNPQSMGFISVHDLRKLLLMELLCEGSFSRMQSGFLRKANR ILDETAEGKLQFSALFPEMRHRFIPPQNPKSKDRREKAETTLEKY KQEIKGRKDKLNSQLLSAFDMNQRQLPSRLLDEWMNIRPASHS VKLRTYVKQLNEDCRLRLRKFRKDGDGKARAIPLVGEMATFLS QDIVRMIISEETKKLITSAYYNEMQRSLAQYAGEENRRQFRAIV AELHLLDPSSGHPFLSATMETAHRYTEDFYKCYLEKKREWLAK TFYRPEQDENTKRRISVFFVPDGEARKLLPLLIRRRMKEQNDLQ DWIRNKQAHPIDLPSHLFDSKIMELLKVKDGKKKWNEAFKDW WSTKYPDGMQPFYGLRRELNIHGKSVSYIPSDGKKFADCYTHL MEKTVQDKKRELRTAGKPVPPDLAADIKRSFHRAVNEREFMLR LVQEDDRLMLMAINKMMTDREEDILPGLKNIDSILDEENQFSLA VHAKVLEKEGEGGDNSLSLVPATIEIKSKRKDWSKYIRYRYDR RVPGLMSHFPEHKATLDEVKTLLGEYDRCRIKIFDWAFALEGAI MSDRDLKPYLHESSSREGKSGEHSTLVKMLVEKKGCLTPDESQ YLILIRNKAAHNQFPCAAEMPLIYRDVSAKVGSIEGSSAKDLPE GSSLVDSLWKKYEMIIRKILPILDHENRFFGKLLNNMSQPINDL |
| HMPREF1990_01800 [*Porphyromonas* | ERJ87335 | MNTVPASENKGQSRTVEDDPQYFGLYLNLARENLIEVESHVRIK FGKKKLNEESLKQSLLCDHLLSVDRWTKVYGHSRRYLPFLHYF |

TABLE 1-continued

| | | |
|---|---|---|
| *gingivalis* W4087] (SEQ ID No. 139) | | DPDSQIEKDHDSKTGVDPDSAQRLIRELYSLLDFLRNDFSHNRL<br>DGTTFEHLEVSPDISSFITGTYSLACGRAQSRFADFFKPDDFVLA<br>KNRKEQLISVADGKECLTVSGLAFFICLFLDREQASGMLSRIRGF<br>KRTDENWARAVHETFCDLCIRHPHDRLESSNTKEALLLDMLNE<br>LNRCPRILYDMLPEEERAQFLPALDENSMNNLSENSLNEESRLL<br>WDGSSDWAEALTKRIRHQDRFPYLMLRFIEEMDLLKGIRFRVD<br>LGEIELDSYSKKVGRNGEYDRTITDHALAFGKLSDFQNEEEVSR<br>MISGEASYPVRFSLFAPRYAIYDNKIGYCHTSDPVYPKSKTGEK<br>RALSNPRSMGFISVHDLRKLLLMELLCEGSFSRMQSDFLRKANR<br>ILDETAEGKLQFSALFPEMRHRFIPPQNPKSKDRREKAETTLEKY<br>KQEIKGRKDKLNSQLLSAFDMDQRQLPSRLLDEWMNIRPASHS<br>VKLRTYVKQLNEDCRLRLQKFRKDGDGKARAIPLVGEMATFLS<br>QDIVRMIISEETKKLITSAYYNEMQRSLAQYAGEENRHQFRAIV<br>AELRLLDPSSGHPFLSATMETAHRYTEDFYKCYLEKKREWLAK<br>TFYRPEQDENTKRRISVFFVPDGEARKLLPLLIRRRMKEQNDLQ<br>DWIRNKQAHPIDLPSHLFDSKVMELLKVKDGKKKWNEAFKDW<br>WSTKYPDGMQPFYGLRRELNIHGKSVSYIPSDGKKFADCYTHL<br>MEKTVRDKKRELRTAGKPVPPDLAAYIKRSFHRAVNEREFMLR<br>LVQEDDRLMLMAINKIMTDREEDILPGLKNIDSILDKENQFSLA<br>VHAKVLEKEGEGGDNSLSLVPATIEIKSKRKDWSKYIRYRYDR<br>RVPGLMSHFPEHKATLDEVKTLLGEYDRCRIKIFDWAFALEGAI<br>MSDRDLKPYLHESSSREGKSGEHSTLVKMLVEKKGCLTPDESQ<br>YLILIRNKAAHNQFPCAAEIPLIYRDVSAKVGSIEGSSAKDLPEG<br>SSLVDSLWKKYEMIIRKILPILDPENRFFGKLLNNMSQPINDL |
| M573_117042 [*Prevotella intermedia* ZT] (SEQ ID No. 140) | KJJ86756 | MKMEDDKKTTESTNMLDNKHFWAAFLNLARHNVYITVNHINK<br>VLELKNKKDQDIIIDNDQDILAIKTHWEKVNGDLNKTERLRELM<br>TKHFPFLETAIYTKNKEDKEEVKQEKQAEAQSLESLKDCLFLFL<br>EKLQEARNYYSHYKYSESTKEPMLEEGLLEKMYNIFDDNIQLVI<br>KDYQHNKDINPDEDFKHLDRKGQFKYSFADNEGNITESGLLFF<br>VSLFLEKKDAIWMQQKLTGFKDNRESKKKMTHEVFCRRRMLL<br>PKLRLESTQTQDWILLDMLNELIRCPKSLYERLQGEYRKKFNVP<br>FDSADEDYDAEQEPFKNTLVRHQDREPYFALRYFDYNEIFTNLR<br>FQIDLGTYHFSIYKKLIGGQKEDRHLTHKLYGFERIQEFAKQNRP<br>DEWKALVKDLDTYETSNERYISETTPHYHLENQKIGIRFRNGNK<br>EIWPSLKTNGENNEKSKYKLDKPYQAEAFLSVHELLPMMFYYL<br>LLKKEEPNNDKKNASIVEGFIKREIRDMYKLYDAFANGEINNIG<br>DLEKYCEDKGIPKRHLPKQMVAILYDEPKDMVKEAKRKQKEM<br>VKDTKKLLATLEKQTQEEIEDGGRNIRLLKSGEIARWLVNDMM<br>RFQPVQKDNEGNPLNNSKANSTEYQMLQRSLALYNKEEKPTRY<br>FRQVNLINSSNPHPFLKWTKWEECNNILSFYRNYLTKKIEFLNK<br>LKPEDWEKNQYFLKLKEPKTNRETLVQGWKNGFNLPRGIFTEPI<br>REWFKRHQNDSKEYEKVEALKRVGLVTKVIPLEFKEEYEKEDA<br>QKEINNCVQPFYSFPYNVGNIHKPDEKDFLPSEERKKLWGDKK<br>DKFKGYKAKVKSKKLTDKEKEEYRSYLEFQSWNKFERELRLV<br>RNQDIVTWLLCTELIDKMKVEGLNVEELQKLRLKDIDTDTAKQ<br>EKNNILNRIMPMQLPVTVYEIDDSHNIVKDRPLHTVYIEETKTKL<br>LKQGNFKALVKDRRLNGLFSFVDTSSKAELKDKPISKSVVEYEL<br>GEYQNARIETIKDMLLLEKTLIKKYEKLPTDNFSDMLNGWLEG<br>KDESDKARFQNDVKLLVAVRNAFSHNQYPMRNRIAFANINPFS<br>LSSADISEEKKLDIANQLKDKTHKIIKKIIEIEKPIETKE |
| A2033_10205 [*Bacteroidetes bacterium* GWA2_31_9] (SEQ ID No. 141) | OFX18020.1 | MENQTQKGKGIYYYYTKNEDKHYFGSFLNLANNNIEQIIEEFRI<br>RLSLKDEKNIKEIINNYFTDKKSYTDWERGINILKEYLPVIDYLD<br>LAITDKEFEKIDLKQKETAKRKYFRTNFSLLIDTIIDLRNFYTHYF<br>HKPISINPDVAKFLDKNLLNVCLDIKKQKMKTDKTKQALKDGL<br>DKELKKLIELKKAELKEKKIKTWNITENVEGAVYNDAFNHMVY<br>KNNAGVTILKDYHKSILPDDKIDSELKLNFSISGLVFLLSMFLSK<br>KEIEQFKSNLEGFKGKVIGENGEYEISKFNNSLKYMATHWIFSY<br>LTFKGLKQRVKNTEDKETLLMQMIDELNKVPHEVYQTLSKEQQ<br>NEFLEDINEYVQDNEENKKSMENSIVVHPVIRKRYDDKENYFAI<br>RELDEFANEPTLKFFVTAGNEVHDKREKQIQGSMLTSDRMIKEK<br>INVFGKLTEIAKYKSDYFSNENTLETSEWELFPNPSYLLIQNNIPV<br>HIDLIHNTEEAKQCQIAIDRIKCTTNPAKKRNTRKSKEEIIKIIYQ<br>KNKNIKYGDPTALLSSNELPALIYELLVNKKSGKELENIIVEKIV<br>NQYKTIAGFEKGQNLSNSLITKKLKKSEPNEDKINAEKIILAINRE<br>LEITENKLNIIKNNRAEFRTGAKRKHIFYSKELGQEATWIAYDLK<br>RFMPEASRKEWKGEHHSELQKFLAFYDRNKNDAKALLNMFW<br>NFDNDQLIGNDLNSAFREFHFDKEYEKYLIKRDEILEGFKSFISN<br>FKDEPKLLKKGIKDIYRVEDKRYYIIKSTNAQKEQLLSKPICLPR<br>GIFDNKPTYIEGVKVESNSALFADWYQYTYSDKHEFQSFYDMP<br>RDYKEQFEKFELNNIKSIQNKKNLNKSDKFIYFRYKQDLKIKQIK<br>SQDLFIKLMVDELENVVEKNNIELNLKKLYQTSDERFKNQLIAD<br>VQKNREKGDTSDNKMNENFIWNMTIPLSLCNGQIEEPKVKLKD<br>IGKFRKLETDDKVIQLLEYDKSKVWKKLEIEDELENMPNSYERI<br>RREKLLKGIQEFEHFLLEKEKEDGINHPKHFEQDLNPNEKTYVIN<br>GVLRKNSKLNYTEIDKLLDLEHISIKDIETSAKEIHLAYFLIHVRN<br>KFGHNQLPKLEAFELMKKYYKKNNEETYAEYFHKVSSQIVNEF<br>KNSLEKHS |

TABLE 1-continued

| | | |
|---|---|---|
| SAMN05421542_0666 [*Chryseobacterium jejuense*] (SEQ ID No. 142) | SDI27289.1 | MEKTQTGLGIYYDHTKLQDKYFFGGFFNLAQNNIDNVIKAFIIK<br>FFPERKDKDINIAQFLDICFKDNDADSDFQKKNKFLRIHFPVIGF<br>LTSDNDKAGFKKKFALLLKTISELRNFYTHYYHKSIEFPSELFEL<br>LDDIFVKTTSEIKKLKKKDDKTQQLLNKNLSEEYDIRYQQQIER<br>LKELKAQGKRVSLTDETAIRNGVFNAAFNHLIYRDGENVKPSR<br>LYQSSYSEPDPAENGISLSQNSILFLLSMFLERKETEDLKSRVKG<br>FKAKIIKQGEEQISGLKFMATHWVFSYLCFKGIKQKLSTEFHEET<br>LLIQIIDELSKVPDEVYSAFDSKTKEKFLEDINEYMKEGNADLSL<br>EDSKVIHPVIRKRYENKFNYFAIRFLDEYLSSTSLKFQVHVGNY<br>VHDRRVKHINGTGFQTERIVKDRIKVFGRLSNISNLKADYIKEQ<br>LELPNDSNGWEIFPNPSYIFIDNNVPIHVLADEATKKGIELFKDK<br>RRKEQPEELQKRKGKISKYNIVSMIYKEAKGKDKLRIDEPLALL<br>SLNEIPALLYQILEKGATPKDIELIIKNKLTERFEKIKNYDPETPAP<br>ASQISKRLRNNTTAKGQEALNAEKLSLLIEREIENTETKLSSIEEK<br>RLKAKKEQRRNTPQRSIFSNSDLGRIAAWLADDIKRFMPAEQRK<br>NWKGYQHSQLQQSLAYFEKRPQEAFLLLKEGWDTSDGSSYWN<br>NWVMNSFLENNHFEKFYKNYLMKRVKYFSELAGNIKQHTHNT<br>KFLRKFIKQQMPADLFPKRHYILKDLETEKNKVLSKPLVFSRGL<br>FDNNPTFIKGVKVTENPELFAEWYSYGYKTEHVFQHFYGWERD<br>YNELLDSELQKGNSFAKNSIYYNRESQLDLIKLKQDLKIKKIKIQ<br>DLFLKRIAEKLFENVFNYPTTLSLDEFYLTQEERAEKERIALAQS<br>LREEGDNSPNIIKDDFIWSKTIAFRSKQIYEPAIKLKDIGKFNRFV<br>LDDEESKASKLLSYDKNKIWNKEQLERELSIGENSYEVIRREKL<br>FKEIQNLELQILSNWSWDGINHPREFEMEDQKNTRHPNFKMYL<br>VNGILRKNINLYKEDEDFWLESLKENDFKTLPSEVLETKSEMVQ<br>LLFLVILIRNQFAHNQLPEIQFYNFIRKNYPEIQNNTVAELYLNLI<br>KLAVQKLKDNS |
| SAMN05444360_11366 [*Chryseobacterium carnipullorum*] (SEQ ID No. 143) | SHM52812.1 | MNTRVTGMGVSYDHTKKEDKHFFGGFLNLAQDNITAVIKAFCI<br>KFDKNPMSSVQFAESCFTDKDSDTDFQNKVRYVRTHLPVIGYL<br>NYGGDRNTFRQKLSTLLKAVDSLRNFYTHYYHSPLALSTELFEL<br>LDTVFASVAVEVKQHKMKDDKTRQLLSKSLAEELDIRYKQQLE<br>RLKELKEQGKNIDLRDEAGIRNGVLNAAFNHLIYKEGEIAKPTL<br>SYSSFYYGADSAENGITISQSGLLFLLSMFLGKKEIEDLKSRIRGF<br>KAKIVRDGEENISGLKFMATHWIFSYLSFKGMKQRLSTDFHEET<br>LLIQIIDELSKVPDEVYHDFDTATREKFVEDINEYIREGNEDFSLG<br>DSTIIHPVIRKRYENKFNYFAVRFLDEFIKFPSLRFQVHLGNFVH<br>DRRIKDIHGTGFQTERVVKDRIKVFGKLSETSSLKTEYIEKELDL<br>DSDTGWEIFPNPSYVFIDNNIPIYISTNKTFKNGSSEFIKLRRKEKP<br>EEMKMRGEDKKEKRDIASMIGNAGSLNSKTPLAMLSLNEMPAL<br>LYEILVKKTTPEEIELIIKEKLDSHFENIKNYDPEKPLPASQISKRL<br>RNNTTDKGKKVINPEKLIHLINKEIDATEAKFALLAKNRKELKE<br>KFRGKPLRQTIFSNMELGREATWLADDIKRFMPDILRKNWKGY<br>QHNQLQQSLAFFNSRPKEAFTILQDGWDFADGSSFWNGWIINSF<br>VKNRSFEYFYEAYFEGRKEYFSSLAENIKQHTSNHRNLRRFIDQ<br>QMPKGLFENRHYLLENLETEKNKILSKPLVFPRGLFDTKPTFIKG<br>IKVDEQPELFAEWYQYGYSTEHVFQNFYGWERDYNDLLESELE<br>KDNDFSKNSIHYSRTSQLELIKLKQDLKIKKIKIQDLFLKLIAGHI<br>FENIFKYPASFSLDELYLTQEERLNKEQEALIQSQRKEGDHSDNII<br>KDNFIGSKTVTYESKQISEPNVKLKDIGKFNRFLLDDKVKTLLS<br>YNEDKVWNKNDLDLELSIGENSYEVIRREKLFKKIQNFELQTLT<br>DWPWNGTDHPEEFGTTDNKGVNHPNFKMYVVNGILRKHTDW<br>FKEGEDNWLENLNETHFKNLSFQELETKSKSIQTAFLIIMIRNQF<br>AHNQLPAVQFFEFIQKKYPEIQGSTTSELYLNFINLAVVELLELL<br>EK |
| SAMN05421786_1011119 [*Chryseobacterium ureilyticum*] (SEQ ID No. 144) | SIS70481.1 | METQILGNGISYDHTKTEDKHFFGGFLNTAQNNIDLLIKAYISKF<br>ESSPRKLNSVQFPDVCFKKNDSDADFQHKLQFIRKHLPVIQYLK<br>YGGNREVLKEKFRLLLQAVDSLRNFYTHFYHKPIQLPNELLTLL<br>DTIFGEIGNEVRQNKMKDDKTRHLLKKNLSEELDFRYQEQLER<br>LRKLKSEGKKVDLRDTEAIRNGVLNAAFNHLIFKDAEDFKPTVS<br>YSSYYYDSDTAENGISISQSGLLFLLSMFLGRREMEDLKSRVRG<br>FKARIIKHEEQHVSGLKFMATHWVFSEFCFKGIKTRLNADYHEE<br>TLLIQLIDELSKVPDELYRSFDVATRERFIEDINEYIRDGKEDKSL<br>IESKIVHPVIRKRYESKFNYFAIRFLDEFVNFPTLRFQVHAGNYV<br>HDRRIKSIEGTGFKTERLVKDRIKVFGKLSTISSLKAEYLAKAVN<br>ITDDTGWELLPHPSYVFIDNNIPIHLTVDPSFKNGVKEYQEKRKL<br>QKPEEMKNRQGGDKMHKPAISSKIGKSKDINPESPVALLSMNEI<br>PALLYEILVKKASPEEVEAKIRQKLTAVFERIRDYDPKVPLPASQ<br>VSKRLRNNTDTLSYNKEKLVELANKEVEQTERKLALITKNRRE<br>CREKVKGKFKRQKVFKNAELGTEATWLANDIKRFMPEEQKKN<br>WKGYQHSQLQQSLAFFESRPGEARSLLQAGWDFSDGSSFWNG<br>WVMNSFARDNTFDGFYESYLNGRMKYFLRLADNIAQQSSTNK<br>LISNFIKQQMPKGLFDRRLYMLEDLATEKNKILSKPLIFPRGIFD<br>DKPTFKKGVQVSEEPEAFADWYSYGYDVKHKFQEFYAWDRD<br>YEELLREELEKDTAFTKNSIHYSRESQIELLAKKQDLKVKKVRI<br>QDLYLKLMAEFLFENVFGHELALPLDQFYLTQEERLKQEQEAIV<br>QSQRPKGDDSPNIVKENFIWSKTIPFKSGRVFEPNVKLKDIGKFR<br>NLLTDEKVDILLSYNNTEIGKQVIENELIIGAGSYEFIRREQLFKEI<br>QQMKRLSLRSVRGMGVPIRLNLK |

TABLE 1-continued

| | | |
|---|---|---|
| *Prevotella buccae* (SEQ ID No. 145) | WP_004343581 | MQKQDKLFVDRKKNAIFAFPKYITIMENQEKPEPIYYELTDKHF<br>WAAFLNLARHNVYTTINHINRRLEIAELKDDGYMMDIKGSWNE<br>QAKKLDKKVRLRDLIMKHFPFLEAAAYEITNSKSPNNKEQREK<br>EQSEALSLNNLKNVLFIFLEKLQVLRNYYSHYKYSEESPKPIFET<br>SLLKNMYKVFDANVRLVKRDYMHHENIDMQRDFTHLNRKKQ<br>VGRTKNIIDSPNFHYHFADKEGNMTIAGLLFFVSLFLDKKDAIW<br>MQKKLKGFKDGRNLREQMTNEVFCRSRISLPKLKLENVQTKD<br>WMQLDMLNELVRCPKSLYERLREKDRESFKVPFDIFSDDYDAE<br>EEPFKNTLVRHQDRFPYFVLRYFDLNEIFEQLRFQIDLGTYHFSI<br>YNKRIGDEDEVRHLTHHLYGFARIQDFAQQNQPEVWRKLVKD<br>LDYFEASQEPYIPKTAPHYHLENEKIGIKFCSTHNNLFPSLKTEK<br>TCNGRSKFNLGTQFTAEAFLSVHELLPMMFYYLLLTKDYSRKE<br>SADKVEGIIRKEISNIYAIYDAFANGEINSIADLTCRLQKTNILQG<br>HLPKQMISILEGRQKDMEKEAERKIGEMIDDTQRRLDLLCKQTN<br>QKIRIGKRNAGLLKSGKIADWLVNDMMRFQPVQKDQNNIPINN<br>SKANSTEYRMLQRALALFGSENFRLKAYFNQMNLVGNDNPHP<br>FLAETQWEHQTNILSFYRNYLEARKKYLKGLKPQNWKQYQHF<br>LILKVQKTNRNTLVTGWKNSFNLPRGIFTQPIREWFEKHNNSKR<br>IYDQILSFDRVGFVAKAIPLYFAEEYKDNVQPFYDYPFNIGNKL<br>KPQKGQFLDKKERVELWQKNKELFKNYPSEKKKTDLAYLDFL<br>SWKKFERELRLIKNQDIVTWLMFKELFNMATVEGLKIGEIHLRD<br>IDTNTANEESNNILNRIMPMKLPVKTYETDNKGNILKERPLATF<br>YIEETETKVLKQGNFKVLAKDRRLNGLLSFAETTDIDLEKNPITK<br>LSVDHELIKYQTTRISIFEMTLGLEKKLINKYPTLPTDSFRNMLE<br>RWLQCKANRPELKNYVNSLIAVRNAFSHNQYPMYDATLFAEV<br>KKFTLFPSVDTKKIELNIAPQLLEIVGKAIKEIEKSENKN |
| *Porphyromonas gingivalis* (SEQ ID No. 146) | WP_005873511 | MNTVPASENKGQSRTVEDDPQYFGLYLNLARENLIEVESHVRIK<br>FGKKKLNEESLKQSLLCDHLLSVDRWTKVYGHSRRYLPFLHYF<br>DPDSQIEKDHDSKTGVDPDSAQRLIRELYSLLDFLRNDFSHNRL<br>DGTTFEHLEVSPDISSFITGTYSLACGRAQSRFADFFKPDDFVLA<br>KNRKEQLISVADGKECLTVSGLAFFICLFLDREQASGMLSRIRGF<br>KRTDENWARAVHETFCDLCIRHPHDRLESSNTKEALLLDMLNE<br>LNRCPRILYDMLPEEERAQFLPALDENSMNNLSENSLNEESRLL<br>WDGSSDWAEALTKRIRHQDRFPYLMLRFIEEMDLLKGIRFRVD<br>LGEIELDSYSKKVGRNGEYDRTITDHALAFGKLSDFQNEEEVSR<br>MISGEASYPVRFSLFAPRYAIYDNKIGYCHTSDPVYPKSKTGEK<br>RALSNPQSMGFISVHNLRKLLLMELLCEGSFSRMQSDFLRKANR<br>ILDETAEGKLQFSALFPEMRHRFIPPQNPKSKDRREKAETTLEKY<br>KQEIKGRKDKLNSQLLSAFDMNQRQLPSRLLDEWMNIRPASHS<br>VKLRTYVKQLNEDCRLRLRKFRKDGDGKARAIPLVGEMATFLS<br>QDIVRMIISEETKKLITSAYYNEMQRSLAQYAGEENRRQFRAIV<br>AELHLLDPSSGHPFLSATMETAHRYTEDFYKCYLEKKREWLAK<br>TFYRPEQDENTKRRISVFFVPDGEARKLLPLLIRRRMKEQNDLQ<br>DWIRNKQAHPIDLPSHLFDSKIMELLKVKDGKKKWNEAFKDW<br>WSTKYPDGMQPFYGLRRELNIHGKSVSYIPSDGKKFADCYTHL<br>MEKTVQDKKRELRTAGKPVPPDLAADIKRSFHRAVNEREFMLR<br>LVQEDDRLMLMAINKMMTDREEDILPGLKNIDSILDEENQFSLA<br>VHAKVLEKEGEGGDNSLSLVPATIEIKSKRKDWSKYIRYRYDR<br>RVPGLMSHFPEHKATLDEVKTLLGEYDRCRIKIFDWAFALEGAI<br>MSDRDLKPYLHESSSREGKSGEHSTLVKMLVEKKGCLTPDESQ<br>YLILIRNKAAHNQFPCAAEMPLIYRDVSAKVGSIEGSSAKDLPE<br>GSSLVDSLWKKYEMIIRKILPILDPENRFFGKLLNNMSQPINDL |
| *Porphyromonas gingivalis* (SEQ ID No. 147) | WP_005874195 | MTEQNEKPYNGTYYTLEDKHFWAAFFNLARHNAYITLAHIDRQ<br>LAYSKADITNDEDILFFKGQWKNLDNDLERKARLRSLILKHFSF<br>LEGAAYGKKLFESQSSGNKSSKKKELTKKEKEELQANALSLDN<br>LKSILFDFLQKLKDFRNYYSHYRHPESSELPLFDGNMLQRLYNV<br>FDVSVQRVKRDHEHNDKVDPHRHFNHLVRKGKKDKYGNNDN<br>PFFKHHFVDREEKVTEAGLLFFVSLFLEKRDAIWMQKKIRGFKG<br>GTEAYQQMTNEVFCRSRISLPKLKLESLRTDDWMLLDMLNELV<br>RCPKSLYDRLREEDRARFRVPVDILSDEDDTDGTEEDPFKNTLV<br>RHQDRFPYFALRYFDLKKVFTSLRFHIDLGTYHFAIYKKNIGEQ<br>PEDRHLTRNLYGFGRIQDFAEEHRPEEWKRLVRDLDYFETGDK<br>PYITQTTPHYHIEKGKIGLRFVPEGQLLWPSPEVGATRTGRSKY<br>AQDKRFTAEAFLSVHELMPMMFYYFLLREKYSEEASAEKVQG<br>RIKRVIEDVYAVYDAFARDEINTRDELDACLADKGIRRGHLPRQ<br>MIAILSQEHKDMEEKVRKKLQEMIADTDHRLDMLDRQTDRKIR<br>IGRKNAGLPKSGVIADWLVRDMMRFQPVAKDTSGKPLNNSKA<br>NSTEYRMLQRALALFGGEKERLTPYFRQMNLTGGNNPHPFLHE<br>TRWESHTNILSFYRSYLKARKAFLQSIGRSDREENHRFLLLKEPK<br>TDRQTLVAGWKSEFHLPRGIFTEAVRDCLIEMGYDEVGSYKEV<br>GFMAKAVPLYFERACKDRVQPFYDYPFNVGNSLKPKKGRFLSK<br>EKRAEEWESGKERFRDLEAWSHSAARRIEDAFVGIEYASWENK<br>KKIEQLLQDLSLWETFESKLKVKADKINIAKLKKEILEAKEHPY<br>HDFKSWQKFERELRLVKNQDIITWMMCRDLMEENKVEGLDTG<br>TLYLKDIRTDVQEQGSLNVLNHVKPMRLPVVVYRADSRGHVH<br>KEEAPLATVYIEERDTKLLKQGNFKSFVKDRRLNGLFSFVDTGA<br>LAMEQYPISKLRVEYELAKYQTARVCAFEQTLELEESLLTRYPH |

TABLE 1-continued

| | | |
|---|---|---|
| | | LPDESFREMLESWSDPLLDKWPDLQREVRLLIAVRNAFSHNQY PMYDETIFSSIRKYDPSSLDAIEERMGLNIAHRLSEEVKLAKEMV ERIIQA |
| *Prevotella pallens* (SEQ ID No. 148) | WP_006044833 | MKEEEKGKTPVVSTYNKDDKHFWAAFLNLARHNVYITVNHIN KILGEGEINRDGYENTLEKSWNEIKDINKKDRLSKLIIKHFPFLE VTTYQRNSADTTKQKEEKQAEAQSLESLKKSFFVFIYKLRDLRN HYSHYKHSKSLERPKFEEDLQEKMYNIFDASIQLVKEDYKHNT DIKTEEDFKHLDRKGQFKYSFADNEGNITESGLLFFVSLFLEKK DAIWVQKKLEGFKCSNESYQKMTNEVFCRSRMLLPKLRLQSTQ TQDWILLDMLNELIRCPKSLYERLREEDRKKFRVPIEIADEDYD AEQEPFKNALVRHQDRFPYFALRYFDYNEIFTNLRFQIDLGTYH FSIYKKQIGDYKESHHLTHKLYGFERIQEFTKQNRPDEWRKFVK TFNSFETSKEPYIPETTPHYHLENQKIGIRFRNDNDKIWPSLKTNS EKNEKSKYKLDKSFQAEAFLSVHELLPMMFYYLLLKTENTDND NEIETKKKENKNDKQEKHKIEEIIENKITEIYALYDAFANGKINSI DKLEEYCKGKDIEIGHLPKQMIAILKSEHKDMATEAKRKQEEM LADVQKSLESLDNQINEEIENVERKNSSLKSGEIASWLVNDMM RFQPVQKDNEGNPLNNSKANSTEYQMLQRSLALYNKEEKPTRY FRQVNLIESSNPHPFLNNTEWEKCNNILSFYRSYLEAKKNFLESL KPEDWEKNQYFLMLKEPKTNCETLVQGWKNGFNLPRGIFTEPI RKWFMEHRKNITVAELKRVGLVAKVIPLFFSEEYKDSVQPFYN YLFNVGNINKPDEKNFLNCEERRELLRKKKDEFKKMTDKEKEE NPSYLEFQSWNKFERELRLVRNQDIVTWLLCMELFNKKKIKEL NVEKIYLKNINTNTTKKEKNTEEKNGEEKIIKEKNNILNRIMPMR LPIKVYGRENFSKNKKKKIRRNTFFTVYIEEKGTKLLKQGNFKA LERDRRLGGLFSFVKTHSKAESKSNTISKSRVEYELGEYQKARIE IIKDMLALEETLIDKYNSLDTDNFHNMLTGWLKLKDEPDKASF QNDVDLLIAVRNAFSHNQYPMRNRIAFANINPFSLSSANTSEEK GLGIANQLKDKTHKTIEKIIEIEKPIETKE |
| *Myroides odoratimimus* (SEQ ID No. 149) | WP_006261414 | MKDILTTDTTEKQNRFYSHKIADKYFFGGYFNLASNNIYEVFEE VNKRNTFGKLAKRDNGNLKNYIIHVFKDELSISDFEKRVAIFAS YFPILETVDKKSIKERNRTIDLTLSQRIRQFREMLISLVTAVDQLR NFYTHYHHSEIVIENKVLDFLNSSLVSTALHVKDKYLKTDKTKE FLKETIAAELDILIEAYKKKQIEKKNTRFKANKREDILNAIYNEA FWSFINDKDKDKETVVAKGADAYFEKNHHKSNDPDFALNISEK GIVYLLSFFLTNKEMDSLKANLTGFKGKVDRESGNSIKYMATQ RIYSFHTYRGLKQKIRTSEEGVKETLLMQMIDELSKVPNVVYQH LSTTQQNSFIEDWNEYYKDYEDDVETDDLSRVIHPVIRKRYEDR FNYFAIRFLDEFFDFPTLRFQVHLGDYVHDRRTKQLGKVESDRII KEKVTVFARLKDINSAKANYFHSLEEQDKEELDNKWTLFPNPS YDFPKEHTLQHQGEQKNAGKIGIYVKLRDTQYKEKAALEEARK SLNPKERSATKASKYDIITQIIEANDNVKSEKPLVFTGQPIAYLS MNDIHSMLFSLLTDNAELKKTPEEVEAKLIDQIGKQINEILSKDT DTKILKKYKDNDLKETDTDKITRDLARDKEEIEKLILEQKQRAD DYNYTSSTKFNIDKSRKRKHLLFNAEKGKIGVWLANDIKRFMT EEFKSKWKGYQHTELQKLFAYYDTSKSDLDLILSDMVMVKDY PIELIALVKKSRTLVDFLNKYLEARLGYMENVITRVKNSIGTPQF KTVRKECFTFLKKSNYTVVSLDKQVERILSMPLFIERGFMDDKP TMLEGKSYQQHKEKFADWFVHYKENSNYQNFYDTEVYEITTE DKREKAKVTKKIKQQQKNDVFTLMMVNYMLEEVLKLSSNDRL SLNELYQTKEERIVNKQVAKDTQERNKNYIWNKVVDLQLCEG LVRIDKVKLKDIGNFRKYENDSRVKEFLTYQSDIVWSAYLSNEV DSNKLYVIERQLDNYESIRSKELLKEVQEIECSVYNQVANKESL KQSGNENFKQYVLQGLVPIGMDVREMLILSTDVKFIKEEIIQLG QAGEVEQDLYSLIYIRNKFAHNQLPIKEFFDFCENNYRSISDNEY YAEYYMEIFRSIKEKYTS |
| *Myroides odoratimimus* (SEQ ID No. 150) | WP_006265509 | MKDILTTDTTEKQNRFYSHKIADKYFFGGYFNLASNNIYEVFEE VNKRNTFGKLAKRDNGNLKNYIIHVFKDELSISDFEKRVAIFAS YFPILETVDKKSIKERNRTIDLTLSQRIRQFREMLISLVTAVDQLR NFYTHYHHSEIVIENKVLDFLNSSLVSTALHVKDKYLKTDKTKE FLKETIAAELDILIEAYKKKQIEKKNTRFKANKREDILNAIYNEA FWSFINDKDKDKETVVAKGADAYFEKNHHKSNDPDFALNISEK GIVYLLSFFLTNKEMDSLKANLTGFKGKVDRESGNSIKYMATQ RIYSFHTYRGLKQKIRTSEEGVKETLLMQMIDELSKVPNVVYQH LSTTQQNSFIEDWNEYYKDYEDDVETDDLSRVIHPVIRKRYEDR FNYFAIRFLDEFFDFPTLRFQVHLGDYVHDRRTKQLGKVESDRII KEKVTVFARLKDINSAKASYFHSLEEQDKEELDNKWTLFPNPS YDFPKEHTLQHQGEQKNAGKIGIYVKLRDTQYKEKAALEEARK SLNPKERSATKASKYDIITQIIEANDNVKSEKPLVFTGQPIAYLS MNDIHSMLFSLLTDNAELKKTPEEVEAKLIDQIGKQINEILSKDT DTKILKKYKDNDLKETDTDKITRDLARDKEEIEKLILEQKQRAD DYNYTSSTKFNIDKSRKRKHLLFNAEKGKIGVWLANDIKRFMF KESKSKWKGYQHTELQKLFAYFDTSKSDLELILSDMVMVKDYP IELIDLVRKSRTLVDFLNKYLEARLGYIENVITRVKNSIGTPQFKT VRKECFAFLKESNYTVASLDKQIERILSMPLFIERGFMDSKPTML EGKSYQQHKEDFADWFVHYKENSNYQNFYDTEVYEIITEDKRE QAKVTKKIKQQQKNDVFTLMMVNYMLEEVLKLPSNDRLSLNE |

TABLE 1-continued

| | | |
|---|---|---|
| | | LYQTKEERIVNKQVAKDTQERNKNYIWNKVVDLQLCEGLVRID<br>KVKLKDIGNFRKYENDSRVKEFLTYQSDIVWSGYLSNEVDSNK<br>LYVIERQLDNYESIRSKELLKEVQEIECIVYNQVANKESLKQSGN<br>ENFKQYVLQGLLPRGTDVREMLILSTDVKFKKEEIMQLGQVRE<br>VEQDLYSLIYIRNKFAHNQLPIKEFFDFCENNYRPISDNEYYAEY<br>YMEIFRSIKEKYAS |
| *Prevotella* sp. MSX73 (SEQ ID No. 151) | WP_007412163 | MQKQDKLFVDRKKNAIFAFPKYITIMENQEKPEPIYYELTDKHF<br>WAAFLNLARHNVYTTINHINRRLEIAELKDDGYMMGIKGSWNE<br>QAKKLDKKVRLRDLIMKHFPFLEAAAYEITNSKSPNNKEQREK<br>EQSEALSLNNLKNVLFIFLEKLQVLRNYYSHYKYSEESPKPIFET<br>SLLKNMYKVFDANVRLVKRDYMHHENIDMQRDFTHLNRKKQ<br>VGRTKNIIDSPNFHYHFADKEGNMTIAGLLFFVSLFLDKKDAIW<br>MQKKLKGFKDGRNLREQMTNEVFCRSRISLPKLKLENVQTKD<br>WMQLDMLNELVRCPKSLYERLREKDRESFKVPFDIFSDDYDAE<br>EEPFKNTLVRHQDRFPYFVLRYFDLNEIFEQLRFQIDLGTYHFSI<br>YNKRIGDEDEVRHLTHHLYGFARIQDFAPQNQPEEWRKLVKDL<br>DHFETSQEPYISKTAPHYHLENEKIGIKFCSTHNNLFPSLKREKT<br>CNGRSKFNLGTQFTAEAFLSVHELLPMMFYYLLLTKDYSRKES<br>ADKVEGIIRKEISNIYAIYDAFANNEINSIADLTCRLQKTNILQGH<br>LPKQMISILEGRQKDMEKEAERKIGEMIDDTQRRLDLLCKQTNQ<br>KIRIGKRNAGLLKSGKIADWLVSDMMRFQPVQKDTNNAPINNS<br>KANSTEYRMLQHALALFGSESSRLKAYFRQMNLVGNANPHPFL<br>AETQWEHQTNILSFYRNYLEARKKYLKGLKPQNWKQYQHFLIL<br>KVQKTNRNTLVTGWKNSFNLPRGIFTQPIREWFEKHNNSKRIYD<br>QILSFDRVGFVAKAIPLYFAEEYKDNVQPFYDYPFNIGNKLKPQ<br>KGQFLDKKERVELWQKNKELFKNYPSEKNKTDLAYLDFLSWK<br>KFERELRLIKNQDIVTWLMFKELFKTTTVEGLKIGEIHLRDIDTN<br>TANEESNNILNRIMPMKLPVKTYETDNKGNILKERPLATFYIEET<br>ETKVLKQGNFKVLAKDRRLNGLLSFAETTDIDLEKNPITKLSVD<br>YELIKYQTTRISIFEMTLGLEKKLIDKYSTLPTDSFRNMLERWLQ<br>CKANRPELKNYVNSLIAVRNAFSHNQYPMYDATLFAEVKKFTL<br>FPSVDTKKIELNIAPQLLEIVGKAIKEIEKSENKN |
| *Porphyromonas gingivalis* (SEQ ID No. 152) | WP_012458414 | MTEQNERPYNGTYYTLEDKHFWAAFFNLARHNAYITLAHIDRQ<br>LAYSKADITNDEDILFFKGQWKNLDNDLERKARLRSLILKHFSF<br>LEGAAYGKKLFESQSSGNKSSKKKELTKKEKEELQANALSLDN<br>LKSILFDFLQKLKDFRNYYSHYRHPESSELPLFDGNMLQRLYNV<br>FDVSVQRVKRDHEHNDKVDPHRHFNHLVRKGKKDRYGNNDN<br>PFFKHHFVDREEKVTEAGLLFFVSLFLEKRDAIWMQKKIRGFKG<br>GTETYQQMTNEVFCRSRISLPKLKLESLRTDDWMLLDMLNELV<br>RCPKSLYDRLREEDRARFRVPVDILSDEDDTDGTEEDPFKNTLV<br>RHQDRFPYFALRYFDLKKVFTSLRFHIDLGTYHFAIYKKNIGEQ<br>PEDRHLTRNLYGFGRIQDFAEEHRPEEWKRLVRDLDYFETGDK<br>PYITQTTPHYHIEKGKIGLRFVPEGQHLWPSPEVGATRTGRSKY<br>AQDKRLTAEAFLSVHELMPMMFYYFLLREKYSDEASAERVQG<br>RIKRVIEDVYAVYDAFARGEINTRDELDACLADKGIRRGHLPRQ<br>MIGILSQEHKDMEEKVRKKLQEMIVDTDHRLDMLDRQTDRKIR<br>IGRKNAGLPKSGVIADWLVRDMMRFQPVAKDTSGKPLNNSKA<br>NSTEYRMLQRALALFGGEKERLTPYFRQMNLTGGNNPHPFLHE<br>TRWESHTNILSFYRSYLKARKAFLQSIGRSDRVENHRFLLLKEP<br>KTDRQTLVAGWKGEFHLPRGIFTEAVRDCLIEMGLDEVGSYKE<br>VGFMAKAVPLYFERACKDRVQPFYDYPFNVGNSLKPKKGRFLS<br>KEKRAEEWESGKERFRLAKLKKEILEAKEHPYLDFKSWQKFER<br>ELRLVKNQDIITWMICRDLMEENKVEGLDTGTLYLKDIRTDVQ<br>EQGNLNVLNRVKPMRLPVVVYRADSRGHVHKEQAPLATVYIE<br>ERDTKLLKQGNFKSFVKDRRLNGLFSFVDTGALAMEQYPISKL<br>RVEYELAKYQTARVCAFEQTLELEESLLTRYPHLPDKNFRKML<br>ESWSDPLLDKWPDLHGNVRLLIAVRNAFSHNQYPMYDEAVFSS<br>IRKYDPSSPDAIEERMGLNIAHRLSEEVKQAKEMAERIIQA |
| Paludibacter propionicigenes (SEQ ID No. 153) | WP_013446107 | MKTSANNIYFNGINSFKKIFDSKGAIAPIAEKSCRNFDIKAQNDV<br>NKEQRIHYFAVGHTFKQLDTENLFEYVLDENLRAKRPTRFISLQ<br>QFDKEFIENIKRLISDIRNINSHYIHRFDPLKIDAVPTNIIDFLKESF<br>ELAVIQIYLKEKGINYLQFSENPHADQKLVAFLHDKFLPLDEKK<br>TSMLQNETPQLKEYKEYRKYFKTLSKQAAIDQLLFAEKETDYI<br>WNLFDSHPVLTISAGKYLSFYSCLFLLSMFLYKSEANQLISKIKG<br>FKKNTTEEEKSKREIFTFFSKRFNSMDIDSEENQLVKFRDLILYL<br>NHYPVAWNKDLELDSSNPAMTDKLKSKIIELEINRSFPLYEGNE<br>RFATFAKYQIWGKKHLGKSIEKEYINASFTDEEITAYTYETDTCP<br>ELKDAHKKLADLKAAKGLFGKRKEKNESDIKKTETSIRELQHEP<br>NPIKDKLIQRIEKNLLTVSYGRNQDRFMDFSARFLAEINYFGQD<br>ASFKMYHFYATDEQNSELEKYELPKDKKKYDSLKFHQGKLVH<br>FISYKEHLKRYESWDDAFVIENNAIQLKLSFDGVENTVTIQRAL<br>LIYLLEDALRNIQNNTAENAGKQLLQEYYSHNKADLSAFKQILT<br>QQDSIEPQQKTEFKKLLPRRLLNNYSPAINHLQTPHSSLPLILEK<br>ALLAEKRYCSLVVKAKAEGNYDDFIKRNKGKQFKLQFIRKAW<br>NLMYFRNSYLQNVQAAGHHKSFHIERDEFNDFSRYMFAFEELS<br>QYKYYLNEMFEKKGFFENNEFKILFQSGTSLENLYEKTKQKFEI<br>WLASNTAKTNKPDNYHLNNYEQQFSNQLFFINLSHFINYLKSTG |

TABLE 1-continued

| | | |
|---|---|---|
| | | KLQTDANGQIIYEALNNVQYLIPEYYYTDKPERSESKSGNKLYN KLKATKLEDALLYEMAMCYLKADKQIADKAKHPITKLLTSDVE FNITNKEGIQLYHLLVPFKKIDAFIGLKMHKEQQDKKHPTSFLA NIVNYLELVKNDKDIRKTYEAFSTNPVKRTLTYDDLAKIDGHLI SKSIKFTNVTLELERYFIFKESLIVKKGNNIDFKYIKGLRNYYNN EKKKNEGIRNKAFHFGIPDSKSYDQLIRDAEVMFIANEVKPTHA TKYTDLNKQLHTVCDKLMETVHNDYFSKEGDGKKKREAAGQ KYFENIISAK |
| *Porphyromonas gingivalis* (SEQ ID No. 154) | WP_013816155 | MTEQNEKPYNGTYYTLEDKHFWAAFFNLARHNAYITLAHIDRQ LAYSKADITNDEDILFFKGQWKNLDNDLERKARLRSLILKHFSF LEGAAYGKKLFESQSSGNKSSKNKELTKKEKEELQANALSLDN LKSILFDFLQKLKDFRNYYSHYRHPESSELPLFDGNMLQRLYNV FDVSVQRVKRDHEHNDKVDPHRHFNHLVRKGKKDRYGNNDN PFFKHHFVDREGTVTEAGLLFFVSLFLEKRDAIWMQKKIRGFKG GTETYQQMTNEVFCRSRISLPKLKLESLRTDDWMLLDMLNELV RCPKSLYDRLREEDRARFRVPVDILSDEEDTDGAEEDPFKNTLV RHQDRFPYFALRYFDLKKVFTSLRFQIDLGTYHFAIYKKNIGEQ PEDRHLTRNLYGFGRIQDFAEEHRPEEWKRLVRDLDYFETGDK PYITQTTPHYHIEKGKIGLRFVPEGQHLWPSPEVGATRTGRSKY AQDKRFTAEAFLSAHELMPMMFYYFLLREKYSEEASAERVQGR IKRVIEDVYAVYDAFARDEINTRDELDACLADKGIRRGHLPRQ MIGILSQEHKDMEEKIRKKLQEMMADTDHRLDMLDRQTDRKIR IGRKNAGLPKSGVIADWLVRDMMRFQPVAKDTSGKPLNNSKA NSTEYRMLQRALALFGGEKERLTPYFRQMNLTGGNNPHPFLHE TRWESHTNILSFYRSYLKARKAFLQSIGRSDRVENHRFLLLKEP KTDRQTLVAGWKGEFHLPRGIFTEAVRDCLIEMGLDEVGSYKE VGFMAKAVPLYFERACKDWVQPFYNYPFNVGNSLKPKKGRFL SKEKRAEEWESGKERFRLAKLKKEILEAKEHPYLDFKSWQKFE RELRLVKNQDIITWMICGDLMEENKVEGLDTGTLYLKDIRTDV QEQGSLNVLNRVKPMRLPVVVYRADSRGHVHKEQAPLATVYI EERDTKLLKQGNFKSFVKDRRLNGLFSFVDTGALAMEQYPISK LRVEYELAKYQTARVCAFEQTLELEESLLTRCPHLPDKNFRKM LESWSDPLLDKWPDLHRKVRLLIAVRNAFSHNQYPMYDEAVFS SIRKYDPSFPDAIEERMGLNIAHRLSEEVKQAKETVERIIQA |
| *Flavobacterium columnare* (SEQ ID No. 155) | WP_014165541 | MSSKNESYNKQKTFNHYKQEDKYFFGGFLNNADDNLRQVGKE FKTRINFNHNNNELASVFKDYFNKEKSVAKREHALNLLSNYFP VLERIQKHTNHNFEQTREIFELLDTIKKLRDYYTHHYHKPITIN PKIYDFLDDTLLDVLITIKKKKVKNDTSRELLKEKLRPELTQLKN QKREELIKKGKKLLEENLENAVFNHCLRPFLEENKTDDKQNKT VSLRKYRKSKPNEETSITLTQSGLVFLMSFFLHRKEFQVFTSGLE GFKAKVNTIKEEEISLNKNNIVYMITHWSYSYYNFKGLKHRIKT DQGVSTLEQNNTTHSLTNTNTKEALLTQIVDYLSKVPNEIYETL SEKQQKEFEEDINEYMRENPENEDSTFSSIVSHKVIRKRYENKFN YFAMRFLDEYAELPTLRFMVNFGDYIKDRQKKILESIQFDSERII KKEIHLFEKLSLVTEYKKNVYLKETSNIDLSRFPLFPNPSYVMA NNNIPFYIDSRSNNLDEYLNQKKKAQSQNKKRNLTFEKYNKEQ SKDAIIAMLQKEIGVKDLQQRSTIGLLSCNELPSMLYEVIVKDIK GAELENKIAQKIREQYQSIRDFTLDSPQKDNIPTTLIKTINTDSSV TFENQPIDIPRLKNAIQKELTLTQEKLLNVKEHEIEVDNYNRNKN TYKFKNQPKNKVDDKKLQRKYVFYRNEIRQEANWLASDLIHF MKNKSLWKGYMHNELQSFLAFFEDKKNDCIALLETVFNLKED CILTKGLKNLFLKHGNFIDFYKEYLKLKEDFLNTESTFLENGLIG LPPKILKKELSKRFKYIFIVFQKRQFIIKELEEKKNNLYADAINLS RGIFDEKPTMIPFKKPNPDEFASWFVASYQYNNYQSFYELTPDI VERDKKKKYKNLRAINKVKIQDYYLKLMVDTLYQDLFNQPLD KSLSDFYVSKAEREKIKADAKAYQKRNDSSLWNKVIHLSLQNN RITANPKLKDIGKYKRALQDEKIATLLTYDDRTWTYALQKPEK ENENDYKELHYTALNMELQEYEKVRSKELLKQVQELEKQILEE YTDFLSTQIHPADFEREGNPNFKKYLAHSILENEDDLDKLPEKV EAMRELDETITNPIIKKAIVLIIIRNKMAHNQYPPKFIYDLANRFV PKKEEEYFATYFNRVFETITKELWENKEKKDKTQV |
| *Psychroflexus torquis* (SEQ ID No. 156) | WP_015024765 | MESIIGLGLSFNPYKTADKHYFGSFLNLVENNLNAVFAEFKERIS YKAKDENISSLIEKHFIDNMSIVDYEKKISILNGYLPIIDFLDDELE NNLNTRVKNFKKNFIILAEAIEKLRDYYTHFYHDPITFEDNKEPL LELLDEVLLKTILDVKKKYLKTDKTKEILKDSLREEMDLLVIRK TDELREKKKTNPKIQHTDSSQIKNSIFNDAFQGLLYEDKGNNKK TQVSHRAKTRLNPKDIHKQEERDFEIPLSTSGLVFLMSLFLSKKE IEDFKSNIKGFKGKVVKDENHNSLKYMATHRVYSILAFKGLKY RIKTDTFSKETLMMQMIDELSKVPDCVYQNLSETKQKDFIEDW NEYFKDNEENTENLENSRVVHPVIRKRYEDKFNYFAIRFLDEFA NFKTLKFQVFMGYYIHDQRTKTIGTTNITTERTVKEKINVFGKL SKMDNLKKHFFSQLSDDENTDWEFFPNPSYNFLTQADNSPANN IPIYLELKNQQIIKEKDAIKAEVNQTQNRNPNKPSKRDLLNKILK TYEDFHQGDPTAILSLNEIPALLHLFLVKPNNKTGQQIENIIRIKIE KQFKAINHPSKNNKGIPKSLFADTNVRVNAIKLKKDLEAELDM LNKKHIAFKENQKASSNYDKLLKEHQFTPKNKRPELRKYVFYK SEKGEEATWLANDIKRFMPKDFKTKWKGCQHSELQRKLAFYD |

TABLE 1-continued

| | | |
|---|---|---|
| | | RHTKQDIKELLSGCEFDHSLLDINAYFQKDNFEDFFSKYLENRIE<br>TLEGVLKKLHDFKNEPTPLKGVFKNCFKFLKRQNYVTESPEIIK<br>KRILAKPTFLPRGVFDERPTMKKGKNPLKDKNEFAEWFVEYLE<br>NKDYQKFYNAEEYRMRDADFKKNAVIKKQKLKDFYTLQMVN<br>YLLKEVFGKDEMNLQLSELFQTRQERLKLQGIAKKQMNKETG<br>DSSENTRNQTYIWNKDVPVSFFNGKVTIDKVKLKNIGKYKRYE<br>RDERVKTFIGYEVDEKWMMYLPHNWKDRYSVKPINVIDLQIQE<br>YEEIRSHELLKEIQNLEQYIYDHTTDKNILLQDGNPNFKMYVLN<br>GLLIGIKQVNIPDFIVLKQNTNFDKIDFTGIASCSELEKKTIILIAIR<br>NKFAHNQLPNKMIYDLANEFLKIEKNETYANYYLKVLKKMISD<br>LA |
| *Riemerella anatipestifer* (SEQ ID No. 157) | WP_015345620 | MFFSFHNAQRVIFKHLYKAFDASLRMVKEDYKAHFTVNLTRDF<br>AHLNRKGKNKQDNPDFNRYRFEKDGFFTESGLLFFTNLFLDKR<br>DAYWMLKKVSGFKASHKQREKMTTEVFCRSRILLPKLRLESRY<br>DHNQMLLDMLSELSRCPKLLYEKLSEENKKHFQVEADGFLDEI<br>EEEQNPFKDTLIRHQDRFPYFALRYLDLNESFKSIRFQVDLGTYH<br>YCIYDKKIGDEQEKRHLTRTLLSFGRLQDFTEINRPQEWKALTK<br>DLDYKETSNQPFISKTTPHYHITDNKIGFRLGTSKELYPSLEIKDG<br>ANRIAKYPYNSGFVAHAFISVHELLPLMFYQHLTGKSEDLLKET<br>VRHIQRIYKDFEEERINTIEDLEKANQGRLPLGAFPKQMLGLLQ<br>NKQPDLSEKAKIKIEKLIAETKLLSHRLNTKLKSSPKLGKRREKL<br>IKTGVLADWLVKDFMRFQPVAYDAQNQPIKSSKANSTEFWFIR<br>RALALYGGEKNRLEGYFKQTNLIGNTNPHPFLNKFNWKACRNL<br>VDFYQQYLEQREKFLEAIKHQPWEPYQYCLLLKVPKENRKNLV<br>KGWEQGGISLPRGLFTEAIRETLSKDLTLSKPIRKEIKKHGRVGFI<br>SRAITLYFKEKYQDKHQSFYNLSYKLEAKAPLLKKEEHYEYWQ<br>QNKPQSPTESQRLELHTSDRWKDYLLYKRWQHLEKKLRLYRN<br>QDIMLWLMTLELTKNHFKELNLNYHQLKLENLAVNVQEADAK<br>LNPLNQTLPMVLPVKVYPTTAFGEVQYHETPIRTVYIREEQTKA<br>LKMGNFKALVKDRRLNGLFSFIKEENDTQKHPISQLRLRRELEI<br>YQSLRVDAFKETLSLEEKLLNKHASLSSLENEFRTLLEEWKKKY<br>AASSMVTDKHIAFIASVRNAFCHNQYPFYKETLHAPILLFTVAQ<br>PTTEEKDGLGIAEALLKVLREYCEIVKSQI |
| Prevotella pleuritidis (SEQ ID No. 158) | WP_021584635 | MENDKRLEESACYTLNDKHFWAAFLNLARHNVYITVNHINKTL<br>ELKNKKNQEIIIDNDQDILAIKTHWAKVNGDLNKTDRLRELMIK<br>HFPFLEAAIYSNNKEDKEEVKEEKQAKAQSFKSLKDCLFLFLEK<br>LQEARNYYSHYKYSESSKEPEFEEGLLEKMYNTFDASIRLVKED<br>YQYNKDIDPEKDFKHLERKEDFNYLFTDKDNKGKITKNGLLFF<br>VSLFLEKKDAIWMQQKFRGFKDNRGNKEKMTHEVFCRSRMLL<br>PKIRLESTQTQDWILLDMLNELIRCPKSLYERLQGAYREKFKVP<br>FDSIDEDYDAEQEPFRNTLVRHQDRFPYFALRYFDYNEIFKNLR<br>FQIDLGTYHFSIYKKLIGGKKEDRHLTHKLYGFERIQEFTKQNRP<br>DKWQAIIKDLDTYETSNERYISETTPHYHLENQKIGIRFRNDNN<br>DIWPSLKTNGEKNEKSKYNLDKPYQAEAFLSVHELLPMMFYYL<br>LLKMENTDNDKEDNEVGTKKKGNKNNKQEKHKIEEIIENKIKDI<br>YALYDAFTNGEINSIDELAEQREGKDIEIGHLPKQLIVILKNKSK<br>DMAEKANRKQKEMIKDTKKRLATLDKQVKGEIEDGGRNIRLL<br>KSGEIARWLVNDMMRFQPVQKDNEGKPLNNSKANSTEYQMLQ<br>RSLALYNKEEKPTRYFRQVNLIKSSNPHPFLEDTKWEECYNILSF<br>YRNYLKAKIKFLNKLKPEDWKKNQYFLMLKEPKTNRKTLVQG<br>WKNGFNLPRGIFTEPIKEWFKRHQNDSEEYKKVEALDRVGLVA<br>KVIPLFFKEEYFKEDAQKEINNCVQPFYSFPYNVGNIHKPEEKNF<br>LHCEERRKLWDKKKDKFKGYKAKEKSKKMTDKEKEEHRSYLE<br>FQSWNKFERELRLVRNQDILTWLLCTKLIDKLKIDELNIEELQKL<br>RLKDIDTDTAKKEKNNILNRVMPMRLPVTVYEIDKSFNIVKDKP<br>LHTVYIEETGTKLLKQGNFKALVKDRRLNGLFSFVKTSSEAESK<br>SKPISKLRVEYELGAYQKARIDIIKDMLALEKTLIDNDENLPTNK<br>FSDMLKSWLKGKGEANKARLQNDVGLLVAVRNAFSHNQYPM<br>YNSEVFKGMKLLSLSSDIPEKEGLGIAKQLKDKIKETIERIIEIEKE<br>IRN |
| *Porphyromonas gingivalis* (SEQ ID No. 159) | WP_021663197 | MNTVPASENKGQSRTVEDDPQYFGLYLNLARENLIEVESHVRIK<br>FGKKKLNEESLKQSLLCDHLLSVDRWTKVYGHSRRYLPFLHYF<br>DPDSQIEKDHDSKTGVDPDSAQRLIRELYSLLDFLRNDFSHNRL<br>DGTTFEHLEVSPDISSFITGTYSLACGRAQSRFADFFKPDDFVLA<br>KNRKEQLISVADGKECLTVSGLAFFICLFLDREQASGMLSRIRGF<br>KRTDENWARAVHETFCDLCIRHPHDRLESSNTKEALLLDMLNE<br>LNRCPRILYDMLPEEERAQFLPALDENSMNNLSENSLNEESRLL<br>WDGSSDWAEALTKRIRHQDRFPYLMLRFIEEMDLLKGIRFRVD<br>LGEIELDSYSKKVGRNGEYDRTITDHALAFGKLSDFQNEEEVSR<br>MISGEASYPVRFSLFAPRYAIYDNKIGYCHTSDPVYPKSKTGEK<br>RALSNPRSMGFISVHDLRKLLLMELLCEGSFSRMQSDFLRKANR<br>ILDETAEGKLQFSALFPEMRHRFIPPQNPKSKDRREKAETTLEKY<br>KQEIKGRKDKLNSQLLSAFDMDQRQLPSRLLDEWMNIRPASHS<br>VKLRTYVKQLNEDCRLRLQKFRKDGDGKARAIPLVGEMATFLS<br>QDIVRMIISEETKKLITSAYYNEMQRSLAQYAGEENRHQFRAIV<br>AELRLLDPSSGHPFLSATMETAHRYTEDFYKCYLEKKREWLAK<br>TFYRPEQDENTKRRISVFFVPDGEARKLLPLLIRRRMKEQNDLQ |

TABLE 1-continued

| | | |
|---|---|---|
| | | DWIRNKQAHPIDLPSHLFDSKIMELLKVKDGKKKWNEAFKDW<br>WSTKYPDGMQPFYGLRRELNIHGKSVSYIPSDGKKFADCYTHL<br>MEKTVQDKKRELRTAGKPVPPDLAADIKRSFHRAVNEREFMLR<br>LVQEDDRLMLMAINKMMTDREEDILPGLKNIDSILDEENQFSLA<br>VHAKVLEKEGEGGDNSLSLVPATIEIKSKRKDWSKYIRYRYDR<br>RVPGLMSHFPEHKATLDEVKTLLGEYDRCRIKIFDWAFALEGAI<br>MSDRDLKPYLHESSSREGKSGEHSTLVKMLVEKKGCLTPDESQ<br>YLILIRNKAAHNQFPCAAEMPLIYRDVSAKVGSIEGSSAKDLPE<br>GSSLVDSLWKKYEMIIRKILPILDPENRFFGKLLNNMSQPINDL |
| *Porphyromonas gingivalis* (SEQ ID No. 160) | WP_021665475 | MNTVPASENKGQSRTVEDDPQYFGLYLNLARENLIEVESHVRIK<br>FGKKKLNEESLKQSLLCDHLLSVDRWTKVYGHSRRYLPFLHYF<br>DPDSQIEKDHDSKTGVDPDSAQRLIRELYSLLDFLRNDFSHNRL<br>DGTTFEHLEVSPDISSFITGTYSLACGRAQSRFADFFKPDDFVLA<br>KNRKEQLISVADGKECLTVSGLAFFICLFLDREQASGMLSRIRGF<br>KRTNENWARAVHETFCDLCIRHPHDRLESSNTKEALLLDMLNE<br>LNRCPRILYDMLPEEERAQFLPALDENSMNNLSENSLNEESRLL<br>WDGSSDWAEALTKRIRHQDRFPYLMLRFIEEMDLLKGIRFRVD<br>LGEIELDSYSKKVGRNGEYDRTITDHALAFGKLSDFQNEEEVSR<br>MISGEASYPVRFSLFAPRYAIYDNKIGYCHTSDPVYPKSKTGEK<br>RALSNPQSMGFISVHDLRKLLLMELLCEGSFSRMQSGFLRKANR<br>ILDETAEGKLQFSALFPEMRHRFIPPQNPKSKDRREKAETTLEKY<br>KQEIKGRKDKLNSQLLSAFDMNQRQLPSRLLDEWMNIRPASHS<br>VKLRTYVKQLNEDCRLRLRKFRKDGDGKARAIPLVGEMATFLS<br>QDIVRMIISEETKKLITSAYYNEMQRSLAQYAGEENRRQFRAIV<br>AELHLLDPSSGHPFLSATMETAHRYTEDFYKCYLEKKREWLAK<br>TFYRPEQDENTKRRISVFFVPDGEARKLLPLLIRRRMKEQNDLQ<br>DWIRNKQAHPIDLPSHLFDSKIMELLKVKDGKKKWNEAFKDW<br>WSTKYPDGMQPFYGLRRELNIHGKSVSYIPSDGKKFADCYTHL<br>MEKTVQDKKRELRTAGKPVPPDLAADIKRSFHRAVNEREFMLR<br>LVQEDDRLMLMAINKMMTDREEDILPGLKNIDSILDKENQFSLA<br>VHAKVLEKEGEGGDNSLSLVPATIEIKSKRKDWSKYIRYRYDR<br>RVPGLMSHFPEHKATLDEVKTLLGEYDRCRIKIFDWAFALEGAI<br>MSDRDLKPYLHESSSREGKSGEHSTLVKMLVEKKGCLTPDESQ<br>YLILIRNKAAHNQFPCAAEMPLIYRDVSAKVGSIEGSSAKDLPE<br>GSSLVDSLWKKYEMIIRKILPILDHENRFFGKLLNNMSQPINDL |
| Porphyromonas gingivalis (SEQ ID No. 161) | WP_021677657 | MNTVPASENKGQSRTVEDDPQYFGLYLNLARENLIEVESHVRIK<br>FGKKKLNEESLKQSLLCDHLLSVDRWTKVYGHSRRYLPFLHYF<br>DPDSQIEKDHDSKTGVDPDSAQRLIRELYSLLDFLRNDFSHNRL<br>DGTTFEHLEVSPDISSFITGTYSLACGRAQSRFADFFKPDDFVLA<br>KNRKEQLISVADGKECLTVSGLAFFICLFLDREQASGMLSRIRGF<br>KRTDENWARAVHETFCDLCIRHPHDRLESSNTKEALLLDMLNE<br>LNRCPRILYDMLPEEERAQFLPALDENSMNNLSENSLNEESRLL<br>WDGSSDWAEALTKRIRHQDRFPYLMLRFIEEMDLLKGIRFRVD<br>LGEIELDSYSKKVGRNGEYDRTITDHALAFGKLSDFQNEEEVSR<br>MISGEASYPVRFSLFAPRYAIYDNKIGYCHTSDPVYPKSKTGEK<br>RALSNPQSMGFISVHDLRKLLLMELLCEGSFSRMQSGFLRKANR<br>ILDETAEGKLQFSALFPEMRHRFIPPQNPKSKDRREKAETTLEKY<br>KQEIKGRKDKLNSQLLSAFDMNQRQLPSRLLDEWMNIRPASHS<br>VKLRTYVKQLNEDCRLRLRKFRKDGDGKARAIPLVGEMATFLS<br>QDIVRMIISEETKKLITSAYYNEMQRSLAQYAGEENRRQFRAIV<br>AELHLLDPSSGHPFLSATMETAHRYTEDFYKCYLEKKREWLAK<br>TFYRPEQDENTKRRISVFFVPDGEARKLLPLLIRRRMKEQNDLQ<br>DWIRNKQAHPIDLPSHLFDSKIMELLKVKDGKKKWNEAFKDW<br>WSTKYPDGMQPFYGLRRELNIHGKSVSYIPSDGKKFADCYTHL<br>MEKTVQDKKRELRTAGKPVPPDLAADIKRSFHRAVNEREFMLR<br>LVQEDDRLMLMAINKMMTDREEDILPGLKNIDSILDEENQFSLA<br>VHAKVLEKEGEGGDNSLSLVPATIEIKSKRKDWSKYIRYRYDR<br>RVPGLMSHFPEHKATLDEVKTLLGEYDRCRIKIFDWAFALEGAI<br>MSDRDLKPYLHESSSREGKSGEHSTLVKMLVEKKGCLTPDESQ<br>YLILIRNKAAHNQFPCAAEMPLIYRDVSAKVGSIEGSSAKDLPE<br>GSSLVDSLWKKYEMIIRKILPILDHENRFFGKLLNNMSQPINDL |
| *Porphyromonas gingivalis* (SEQ ID No. 162) | WP_021680012 | MNTVPASENKGQSRTVEDDPQYFGLYLNLARENLIEVESHVRIK<br>FGKKKLNEESLKQSLLCDHLLSVDRWTKVYGHSRRYLPFLHYF<br>DPDSQIEKDHDSKTGVDPDSAQRLIRELYSLLDFLRNDFSHNRL<br>DGTTFEHLEVSPDISSFITGTYSLACGRAQSRFADFFKPDDFVLA<br>KNRKEQLISVADGKECLTVSGLAFFICLFLDREQASGMLSRIRGF<br>KRTDENWARAVHETFCDLCIRHPHDRLESSNTKEALLLDMLNE<br>LNRCPRILYDMLPEEERAQFLPALDENSMNNLSENSLNEESRLL<br>WDGSSDWAEALTKRIRHQDRFPYLMLRFIEEMDLLKGIRFRVD<br>LGEIELDSYSKKVGRNGEYDRTITDHALAFGKLSDFQNEEEVSR<br>MISGEASYPVRFSLFAPRYAIYDNKIGYCHTSDPVYPKSKTGEK<br>RALSNPRSMGFISVHDLRKLLLMELLCEGSFSRMQSDFLRKANR<br>ILDETAEGKLQFSALFPEMRHRFIPPQNPKSKDRREKAETTLEKY<br>KQEIKGRKDKLNSQLLSAFDMDQRQLPSRLLDEWMNIRPASHS<br>VKLRTYVKQLNEDCRLRLQKFRKDGDGKARAIPLVGEMATFLS<br>QDIVRMIISEETKKLITSAYYNEMQRSLAQYAGEENRHQFRAIV<br>AELRLLDPSSGHPFLSATMETAHRYTEDFYKCYLEKKREWLAK |

TABLE 1-continued

| | | |
|---|---|---|
| | | TFYRPEQDENTKRRISVFFVPDGEARKLLPLLIRRRMKEQNDLQ DWIRNKQAHPIDLPSHLFDSKVMELLKVKDGKKKWNEAFKDW WSTKYPDGMQPFYGLRRELNIHGKSVSYIPSDGKKFADCYTHL MEKTVRDKKRELRTAGKPVPPDLAAYIKRSFHRAVNEREFMLR LVQEDDRLMLMAINKIMTDREEDILPGLKNIDSILDKENQFSLA VHAKVLEKEGEGGDNSLSLVPATIEIKSKRKDWSKYIRYRYDR RVPGLMSHFPEHKATLDEVKTLLGEYDRCRIKIFDWAFALEGAI MSDRDLKPYLHESSSREGKSGEHSTLVKMLVEKKGCLTPDESQ YLILIRNKAAHNQFPCAAEIPLIYRDVSAKVGSIEGSSAKDLPEG SSLVDSLWKKYEMIIRKILPILDPENRFFGKLLNNMSQPINDL |
| *Porphyromonas gingivalis* (SEQ ID No. 163) | WP_023846767 | MNTVPASENKGQSRTVEDDPQYFGLYLNLARENLIEVESHVRIK FGKKKLNEESLKQSLLCDHLLSVDRWTKVYGHSRRYLPFLHYF DPDSQIEKDHDSKTGVDPDSAQRLIRELYSLLDFLRNDFSHNRL DGTTFEHLEVSPDISSFITGTYSLACGRAQSRFADFFKPDDFVLA KNRKEQLISVADGKECLTVSGLAFFICLFLDREQASGMLSRIRGF KRTDENWARAVHETFCDLCIRHPHDRLESSNTKEALLLDMLNE LNRCPRILYDMLPEEERAQFLPALDENSMNNLSENSLNEESRLL WDGSSDWAEALTKRIRHQDRFPYLMLRFIEEMDLLKGIRFRVD LGEIELDSYSKKVGRNGEYDRTITDHALAFGKLSDFQNEEEVSR MISGEASYPVRFSLFAPRYAIYDNKIGYCHTSDPVYPKSKTGEK RALSNPRSMGFISVHDLRKLLLMELLCEGSFSRMQSDFLRKANR ILDETAEGKLQFSALFPEMRHRFIPPQNPKSKDRREKAETTLEKY KQEIKGRKDKLNSQLLSAFDMNQRQLPSRLLDEWMNIRPASHS VKLRTYVKQLNEDCRLRLRKFRKDGDGKARAIPLVGEMATFLS QDIVRMIISEETKKLITSAYYNEMQRSLAQYAGEENRRQFRAIV AELHLLDPSSGHPFLSATMETAHRYTEDFYKCYLEKKREWLAK TFYRPEQDENTKRRISVFFVPDGEARKLLPLLIRRRMKEQNDLQ DWIRNKQAHPIDLPSHLFDSKIMELLKVKDGKKKWNEAFKDW WSTKYPDGMQPFYGLRRELNIHGKSVSYIPSDGKKFADCYTHL MEKTVQDKKRELRTAGKPVPPDLAADIKRSFHRAVNEREFMLR LVQEDDRLMLMAINKMMTDREEDILPGLKNIDSILDEENQFSLA VHAKVLEKEGEGGDNSLSLVPATIEIKSKRKDWSKYIRYRYDR RVPGLMSHFPEHKATLDEVKTLLGEYDRCRIKIFDWAFALEGAI MSDRDLKPYLHESSSREGKSGEHSTLVKMLVEKKGCLTPDESQ YLILIRNKAAHNQFPCAAEMPLIYRDVSAKVGSIEGSSAKDLPE GSSLVDSLWKKYEMIIRKILPILDPENRFFGKLLNNMSQPINDL |
| *Prevotella falsenii* (SEQ ID No. 164) | WP_036884929 | MKNDNNSTKSTDYTLGDKHFWAAFLNLARHNVYITVNHINKV LELKNKKDQEIIIDNDQDILAIKTLWGKVDTDINKKDRLRELIM KHFPFLEAATYQQSSTNNTKQKEEEQAKAQSFESLKDCLFLFLE KLREARNYYSHYKHSKSLEEPKLEEKLLENMYNIFDTNVQLVIK DYEHNKDINPEEDFKHLGRAEGEFNYYFTRNKKGNITESGLLFF VSLFLEKKDAIWAQTKIKGFKDNRENKQKMTHEVFCRSRMLLP KLRLESTQTQDWILLDMLNELIRCPKSLYKRLQGEKREKFRVPF DPADEDYDAEQEPFKNTLVRHQDRFPYFALRYFDYNEIFTNLRF QIDLGTYHFSIYKKQIGDKKEDRHLTHKLYGFERIQEFAKENRP DEWKALVKDLDTFEESNEPYISETTPHYHLENQKIGIRNKNKKK KKTIWPSLETKTTVNERSKYNLGKSFKAEAFLSVHELLPMMFY YLLLNKEEPNNGKINASKVEGIIEKKIRDIYKLYGAFANEEINNE EELKEYCEGKDIAIRHLPKQMIAILKNEYKDMAKKAEDKQKKM IKDTKKRLAALDKQVKGEVEDGGRNIKPLKSGRIASWLVNDM MRFQPVQRDRDGYPLNNSKANSTEYQLLQRTLALFGSERERLA PYFRQMNLIGKDNPHPFLKDTKWKEHNNILSFYRSYLEAKKNF LGSLKPEDWKKNQYFLKLKEPKTNRETLVQGWKNGFNLPRGIF TEPIREWFIRHQNESEEYKKVKDFDRIGLVAKVIPLFFKEDYQKE IEDYVQPFYGYPFNVGNIHNSQEGTFLNKKEREELWKGNKTKF KDYKTKEKNKEKTNKDKFKKKTDEEKEEFRSYLDFQSWKKFE RELRLVRNQDIVTWLLCMELIDKLKIDELNIEELQKLRLKDIDTD TAKKEKNNILNRIMPMELPVTVYETDDSNNIIKDKPLHTIYIKEA ETKLLKQGNFKALVKDRRLNGLFSFVETSSEAELKSKPISKSLVE YELGEYQRARVEIIKDMLRLEETLIGNDEKLPTNKFRQMLDKW LEHKKETDDTDLKNDVKLLTEVRNAFSHNQYPMRDRIAFANIK PFSLSSANTSNEEGLGIAKKLKDKTKETIDRIIEIEEQTATKR |
| Prevotella pleuritidis (SEQ ID No. 165) | WP_036931485 | MENDKRLEESTCYTLNDKHFWAAFLNLARHNVYITINHINKLL EIRQIDNDEKVLDIKALWQKVDKDINQKARLRELMIKHFPFLEA AIYSNNKEDKEEVKEEKQAKAQSFKSLKDCLFLFLEKLQEARN YYSHYKSSESSKEPEFEEGLLEKMYNTFGVSIRLVKEDYQYNKD IDPEKDFKHLERKEDFNYLFTDKDNKGKITKNGLLFFVSLFLEK KDAIWMQQKLRGFKDNRGNKEKMTHEVFCRSRMLLPKIRLES TQTQDWILLDMLNELIRCPKSLYERLQGAYREKFKVPFDSIDED YDAEQEPFRNTLVRHQDRFPYFALRYFDYNEIFKNLRFQIDLGT YHFSIYKKLIGDNKEDRHLTHKLYGFERIQEFAKQKRPNEWQA LVKDLDIYETSNEQYISETTPHYHLENQKIGIRFKNKKDKIWPSL ETNGKENEKSKYNLDKSFQAEAFLSIHELLPMMFYDLLLKKEEP NNDEKNASIVEGFIKKEIKRMYAIYDAFANEEINSKEGLEEYCK NKGFQERHLPKQMIAILTNKSKNMAEKAKRKQKEMIKDTKKR LATLDKQVKGEIEDGGRNIRLLKSGEIARWLVNDMMRFQSVQK DKEGKPLNNSKANSTEYQMLQRSLALYNKEQKPTPYFIQVNLI |

TABLE 1-continued

| | | |
|---|---|---|
| | | KSSNPHPFLEETKWEECNNILSFYRSYLEAKKNFLESLKPEDWK<br>KNQYFLMLKEPKTNRKTLVQGWKNGFNLPRGIFTEPIKEWFKR<br>HQNDSEEYKKVEALDRVGLVAKVIPLFFKEEYFKEDAQKEINN<br>CVQPFYSFPYNVGNIHKPEEKNFLHCEERRKLWDKKKDKFKGY<br>KAKEKSKKMTDKEKEEHRSYLEFQSWNKFERELRLVRNQDIVT<br>WLLCTELIDKLKIDELNIEELQKLRLKDIDTDTAKKEKNNILNRI<br>MPMQLPVTVYEIDKSFNIVKDKPLHTIYIEETGTKLLKQGNFKA<br>LVKDRRLNGLFSFVKTSSEAESKSKPISKLRVEYELGAYQKARI<br>DIIKDMLALEKTLIDNDENLPTNKFSDMLKSWLKGKGEANKAR<br>LQNDVDLLVAIRNAFSHNQYPMYNSEVFKGMKLLSLSSDIPEKE<br>GLGIAKQLKDKIKETIERIIEIEKEIRN |
| [*Porphyromonas gingivalis* (SEQ ID No. 166) | WP_039417390 | MTEQNERPYNGTYYTLEDKHFWAAFFNLARHNAYITLAHIDRQ<br>LAYSKADITNDEDILFFKGQWKNLDNDLERKARLRSLILKHFSF<br>LEGAAYGKKLFESQSSGNKSSKKKELTKKEKEELQANALSLDN<br>LKSILFDFLQKLKDFRNYYSHYRHPESSELPLFDGNMLQRLYNV<br>FDVSVQRVKRDHEHNDKVDPHRHFNHLVRKGKKDRYGNNDN<br>PFFKHHFVDREGTVTEAGLLFFVSLFLEKRDAIWMQKKIRGFKG<br>GTEAYQQMTNEVFCRSRISLPKLKLESLRTDDWMLLDMLNELV<br>RCPKSLYDRLREEDRARFRVPIDILSDEDDTDGTEEDPFKNTLVR<br>HQDRFPYFALRYFDLKKVFTSLRFHIDLGTYHFAIYKKNIGEQPE<br>DRHLTRNLYGFGRIQDFAEEHRPEEWKRLVRDLDYFETGDKPY<br>ITQTTPHYHIEKGKIGLRFVPEGQHLWPSPEVGATRTGRSKYAQ<br>DKRLTAEAFLSVHELMPMMFYYFLLREKYSEEVSAEKVQGRIK<br>RVIEDVYAVYDAFARGEIDTLDRLDACLADKGIRRGHLPRQMI<br>AILSQEHKDMEEKVRKKLQEMIADTDHRLDMLDRQTDRKIRIG<br>RKNAGLPKSGVIADWLVRDMMRFQPVAKDTSGKPLNNSKANS<br>TEYRMLQRALALFGGEKERLTPYFRQMNLTGGNNPHPFLHETR<br>WESHTNILSFYRSYLKARKAFLQSIGRSDREENHRFLLLKEPKT<br>DRQTLVAGWKSEFHLPRGIFTEAVRDCLIEMGYDEVGSYKEVG<br>FMAKAVPLYFERACKDRVQPFYDYPFNVGNSLKPKKGRFLSKE<br>KRAEEWESGKERFRLAKLKKEILEAKEHPYLDFKSWQKFEREL<br>RLVKNQDIITWMMCRDLMEENKVEGLDTGTLYLKDIRTDVHE<br>QGSLNVLNRVKPMRLPVVVYRADSRGHVHKEQAPLATVYIEE<br>RDTKLLKQGNFKSFVKDRRLNGLFSFVDTGALAMEQYPISKLR<br>VEYELAKYQTARVCAFEQTLELEESLLTRYPHLPDKNFRKMLE<br>SWSDPLLDKWPDLHRKVRLLIAVRNAFSHNQYPMYDEAVFSSI<br>RKYDPSSPDAIEERMGLNIAHRLSEEVKQAKEMAERIIQV |
| *Porphyromonas gulae* (SEQ ID No. 167) | WP_094189123 | MTEQSERPYNGTYYTLEDKHFWAAFLNLARHNAYITLTHIDRQ<br>LAYSKADITNDQDVLSFKALWKNLDNDLERKSRLRSLILKHFSF<br>LEGAAYGKKLFESKSSGNKSSKNKELTKKEKEELQANALSLDN<br>LKSILFDFLQKLKDFRNYYSHYRHSGSSELPLFDGNMLQRLYNV<br>FDVSVQRVKRDHEHNDKVDPHRHFNHLVRKGKKDRYGHNDN<br>PSFKHHFVDSEGMVTEAGLLFFVSLFLEKRDAIWMQKKIRGFK<br>GGTETYQQMTNEVFCRSRISLPKLKLESLRMDDWMLLDMLNE<br>LVRCPKPLYDRLREDDRACFRVPVDILPDEDDTDGGGEDPFKN<br>TLVRHQDRFPYFALRYFDLKKVFTSLRFHIDLGTYHFAIYKKMI<br>GEQPEDRHLTRNLYGFGRIQDFAEEHRPEEWKRLVRDLDYFET<br>GDKPYISQTSPHYHIEKGKIGLRFMPEGQHLWPSPEVGTTRTGR<br>SKYAQDKRLTAEAFLSVHELMPMMFYYFLLREKYSEEVSAEKV<br>QGRIKRVIEDVYAIYDAFARDEINTLKELDACLADKGIRRGHLP<br>KQMIAILSQEHKNMEEKVRKKLQEMIADTDHRLDMLDRQTDR<br>KIRIGRKNAGLPKSGVIADWLVRDMMRFQPVAKDASGKPLNNS<br>KANSTEYRMLQRALALFGGEKERLTPYFRQMNLTGGNNPHPFL<br>HDTRWESHTNILSFYRSYLRARKAFLERIGRSDRMENRPFLLLK<br>EPKTDRQTLVAGWKSEFHLPRGIFTEAVRDCLIEMGYDEVGSY<br>REVGFMAKAVPLYFERACEDRVQPFYDSPFNVGNSLKPKKGRF<br>LSKEERAEEWERGKERFRDLEAWSHSAARRIEDAFAGIEYASPG<br>NKKKIEQLLRDLSLWEAFESKLKVRADKINLAKLKKEILEAQEH<br>PYHDFKSWQKFERELRLVKNQDIITWMMCRDLMEENKVEGLD<br>TGTLYLKDIRTNVQEQGSLNVLNHVKPMRLPVVVYRADSRGH<br>VHKEEAPLATVYIEERDTKLLKQGNFKSFVKDRRLNGLFSFVDT<br>GGLAMEQYPISKLRVEYELAKYQTARVCAFEQTLELEESLLTRY<br>PHLPDKNFRKMLESWSDPLLAKWPELHGKVRLLIAVRNAFSHN<br>QYPMYDEAVFSSIRKYDPSSPDAIEERMGLNIAHRLSEEVKQAK<br>ETVERIIQA |
| *Porphyromonas gulae* (SEQ ID No. 168) | WP_039419792 | MTEQSERPYNGTYYTLEDKHFWAAFLNLARHNAYITLTHIDRQ<br>LAYSKADITNDQDVLSFKALWKNLDNDLERKSRLRSLILKHFSF<br>LEGAAYGKKLFESKSSGNKSSKNKELTKKEKEELQANALSLDN<br>LKSILFDFLQKLKDFRNYYSHYRHSGSSELPLFDGNMLQRLYNV<br>FDVSVQRVKRDHEHNDKVDPHRHFNHLVRKGKKDRYGHNDN<br>PSFKHHFVDGEGMVTEAGLLFFVSLFLEKRDAIWMQKKIRGFK<br>GGTETYQQMTNEVFCRSRISLPKLKLESLRTDDWMLLDMLNEL<br>VRCPKPLYDRLREKDRARFRVPVDILPDEDDTDGGGEDPFKNT<br>LVRHQDRFPYFALRYFDLKKVFTSLRFHIDLGTYHFAIYKKVIG<br>EQPEDRHLTRNLYGFGRIQDFAEEHRPEEWKRLVRDLDYFETG<br>DKPYISQTTPHYHIEKGKIGLRFVPEGQHLWPSPEVGTTRTGRSK<br>YAQDKRLTAEAFLSVHELMPMMFYYFLLREKYSEEVSAEKVQ |

TABLE 1-continued

| | | |
|---|---|---|
| | | GRIKRVIEDVYAIYDAFARDEINTRDELDACLADKGIRRGHLPK<br>QMIGILSQEHKNMEEKVRKKLQEMIADTDHRLDMLDRQTDRKI<br>RIGRKNAGLPKSGVIADWLVRDMMRFQPVAKDTSGKPLNNSK<br>ANSTEYRMLQRALALFGGEKERLTPYFRQMNLTGGNNPHPFLD<br>ETRWESHTNILSFYRSYLRARKAFLERIGRSDRVENRPFLLLKEP<br>KTDRQTLVAGWKSEFHLPRGIFTEAVRDCLIEMGYDEVGSYKE<br>VGFMAKAVPLYFERACKDRVQPFYDSPFNVGNSLKPKKGRFLS<br>KEKRAEEWESGKERFRLAKLKKEILEAQEHPYHDFKSWQKFER<br>ELRLVKNQDIITWMMCRDLMEENKVEGLDTGTLYLKDIRPNVQ<br>EQGSLNVLNRVKPMRLPVVVYRADSRGHVHKEEAPLATVYIEE<br>RDTKLLKQGNFKSFVKDRRLNGLFSFVDTGGLAMEQYPISKLR<br>VEYELAKYQTARVCVFELTLRLEESLLSRYPHLPDESFREMLES<br>WSDPLLAKWPELHGKVRLLIAVRNAFSHNQYPMYDEAVFSSIR<br>KYDPSSPDAIEERMGLNIAHRLSEEVKQAKETVERIIQA |
| *Porphyromonas gulae* (SEQ ID No. 169) | WP_039426176 | MTEQSERPYNGTYYTLEDKHFWAAFLNLARHNAYITLTHIDRQ<br>LAYSKADITNDQDVLSFKALWKNFDNDLERKSRLRSLILKHFSF<br>LEGAAYGKKLFESKSSGNKSSKNKELTKKEKEELQANALSLDN<br>LKSILFDFLQKLKDFRNYYSHYRHSGSSELPLFDGNMLQRLYNV<br>FDVSVQRVKRDHEHNDKVDPHYHFNHLVRKGKKDRYGHNDN<br>PSFKHHFVDSEGMVTEAGLLFFVSLFLEKRDAIWMQKKIRGFK<br>GGTGPYEQMTNEVFCRSRISLPKLKLESLRTDDWMLLDMLNEL<br>VRCPKPLYDRLREKDRACFRVPVDILPDEDDTDGGGEDPFKNT<br>LVRHQDRFPYFALRYFDLKKVFTSLRFHIDLGTYHFAIYKKMIG<br>EQPEDRHLTRNLYGFGRIQDFAEEHRPEEWKRLVRDLDYFETG<br>DKPYISQTTPHYHIEKGKIGLRFMPEGQHLWPSPEVGTTRTGRS<br>KYAQDKRLTAEAFLSVHELMPMMFYYFLLREKYSEEVSAEKV<br>QGRIKRVIKDVYAIYDAFARDEINTLKELDACSADKGIRRGHLP<br>KQMIGILSQEHKNMEEKVRKKLQEMIADTDHRLDMLDRQTDR<br>KIRIGRKNAGLPKSGVIADWLVRDMMRFQPVAKDTSGKPLNNS<br>KANSTEYRMLQRALALFGGEKERLTPYFRQMNLTGGNNPHPFL<br>DETRWESHTNILSFYRSYLRARKAFLERIGRSDRVENRPFLLLKE<br>PKNDRQTLVAGWKSEFHLPRGIFTEAVRDCLIEMGYDEVGSYK<br>EVGFMAKAVPLYFERACKDRVQPFYDSPFNVGNSLKPKKGRFL<br>SKEKRAEEWESGKERFRLAKLKKEILEAKEHPYHDFKSWQKFE<br>RELRLVKNQDIITWMMCRDLMEENKVEGLDTGTLYLKDIRTDV<br>HEQGSLNVLNRVKPMRLPVVVYRADSRGHVHKEQAPLATVYI<br>EERDTKLLKQGNFKSFVKDRRLNGLFSFVDTGGLAMEQYPISK<br>LRVEYELAKYQTARVCAFEQTLELEESLLTRYPHLPDENFREML<br>ESWSDPLLGKWPDLHGKVRLLIAVRNAFSHNQYPMYDEAVFSS<br>IRKYDPSSPDAIEERMGLNIAHRLSEEVKQAKETVERIIQA |
| *Porphyromonas gulae* (SEQ ID No. 170) | WP_039431778 | MTEQSERPYNGTYYTLEDKHFWAAFLNLARHNAYITLTHIDRQ<br>LAYSKADITNDQDVLSFKALWKNFDNDLERKSRLRSLILKHFSF<br>LEGAAYGKKLFESKSSGNKSSKNKELTKKEKEELQANALSLDN<br>LKSILFDFLQKLKDFRNYYSHYRHSESSELPLFDGNMLQRLYNV<br>FDVSVQRVKRDHEHNDKVDPHRHFNHLVRKGKKDRYGHNDN<br>PSFKHHFVDGEGMVTEAGLLFFVSLFLEKRDAIWMQKKIRGFK<br>GGTETYQQMTNEVFCRSRISLPKLKLESLRTDDWMLLDMLNEL<br>VRCPKPLYDRLREDDRACFRVPVDILPDEDDTDGGGEDPFKNT<br>LVRHQDRFPYFALRYFDLKKVFTSLRFHIDLGTYHFAIYKKMIG<br>EQPEDRHLTRNLYGFGRIQDFAEEHRPEEWKRLVRDLDYFETG<br>DKPYISQTSPHYHIEKGKIGLRFMPEGQHLWPSPEVGTTRTGRS<br>KYAQDKRLTAEAFLSVHELMPMMFYYFLLREKYSEEVSAEKV<br>QGRIKRVIEDVYAIYDAFARDEINTLKELDACLADKGIRRGHLP<br>KQMIAILSQEHKDMEEKIRKKLQEMIADTDHRLDMLDRQTDRK<br>IRIGRKNAGLPKSGVIADWLVRDMMRFQPVAKDTSGKPLNNSK<br>ANSTEYRMLQRALALFGGEKKRLTPYFRQMNLTGGNNPHPFLH<br>ETRWESHTNILSFYRSYLRARKAFLERIGRSDRMENRPFLLLKEP<br>KTDRQTLVAGWKSEFHLPRGIFTEAVRDCLIEMGYDEVGSYRE<br>VGFMAKAVPLYFERACEDRVQPFYDSPFNVGNSLKPKKGRFLS<br>KEERAEEWERGKERFRDLEAWSHSAARRIEDAFAGIEYASPGN<br>KKKIEQLLRDLSLWEAFESKLKVRADKINLAKLKKEILEAQEHP<br>YHDFKSWQKFERELRLVKNQDIITWMMCRDLMEENKVEGLDT<br>GTLYLKDIRPNVQEQGSLNVLNRVKPMRLPVVVYRADSRGHV<br>HKEEAPLATVYIEERDTKLLKQGNFKSFVKDRRLNGLFSFVDTG<br>GLAMEQYPISKLRVEYELAKYQTARVCVFELTLRLEESLLTRYP<br>HLPDESFRKMLESWSDPLLAKWPELHGKVRLLIAVRNAFSHNQ<br>YPMYDEAVFSSIRKYDPSSPDAIEERMGLNIAHRLSEEVKQAKE<br>TVERIIQV |
| *Porphyromonas gulae* (SEQ ID No. 171) | WP_039437199 | MTEQSERPYNGTYYTLEDKHFWAAFLNLARHNAYITLTHIDRQ<br>LAYSKADITNDEDILFFKGQWKNLDNDLERKSRLRSLILKHFSF<br>LEGAAYGKKFFESKSSGNKSSKNKELTKKEKEELQANALSLDN<br>LKSILFDFLQKLKDFRNYYSHYRHSGSSELPLFDGNMLQRLYNV<br>FDVSVQRVKRDHEHNDEVDPHYHFNHLVRKGKKDRYGHNDN<br>PSFKHHFVDGEGMVTEAGLLFFVSLFLEKRDAIWMQKKIRGFK<br>GGTEPYEQMTNEVFCRSRISLPKLKLESLRTDDWMLLDMLNEL<br>VRCPKPLYDRLREKDRACFRVPVDILPDEDDTDGGGEDPFKNT<br>LVRHQDRFPYFALRYFDLKKVFTSLRFHIDLGTYHFAIYKKMIG |

TABLE 1-continued

| | | |
|---|---|---|
| | | EQPEDRHLTRNLYGFGRIQDFAEEHRPEEWKRLVRDLDYFETG<br>DKPYISQTTPHYHIEKGKIGLRFVPEGQHLWPSPEVGTTRTGRSK<br>YAQDKRLTAEAFLSVHELMPMMFYYFLLREKYSEEVSAEKVQ<br>GRIKRVIEDVYAIYDAFARDEINTLKELDACLADKGIRRGHLPK<br>QMIGILSQERKDMEEKVRKKLQEMIADTDHRLDMLDRQTDRKI<br>RIGRKNAGLPKSGVIADWLVRDMMRFQPVAKDTSGKPLNNSK<br>ANSTEYRMLQRALALFGGEKERLTPYFRQMNLTGGNNPHPFLH<br>ETRWESHTNILSFYRSYLRARKAFLERIGRSDRVENCPFLLLKEP<br>KTDRQTLVAGWKGEFHLPRGIFTEAVRDCLIEMGYDEVGSYRE<br>VGFMAKAVPLYFERACEDRVQPFYDSPFNVGNSLKPKKGRFLS<br>KEKRAEEWESGKERFRLAKLKKEILEAQEHPYHDFKSWQKFER<br>ELRLVKNQDIITWMMCRDLMEENKVEGLDTGTLYLKDIRPNVQ<br>EQGSLNVLNRVKPMRLPVVVYRADSRGHVHKEEAPLATVYIEE<br>RDTKLLKQGNFKSFVKDRRLNGLFSFVDTGALAMEQYPISKLR<br>VEYELAKYQTARVCAFEQTLELEESLLTRYPHLPDESFREMLES<br>WSDPLLTKWPELHGKVRLLIAVRNAFSHNQYPMYDEAVFSSIW<br>KYDPSSPDAIEERMGLNIAHRLSEEVKQAKETIERIIQA |
| *Porphyromonas gulae* (SEQ ID No. 172) | WP_039442171 | MTEQSERPYNGTYYTLEDKHFWAAFLNLARHNAYITLTHIDRQ<br>LAYSKADITNDQDVLSFKALWKNLDNDLERKSRLRSLILKHFSF<br>LEGAAYGKKLFESKSSGNKSSKNKELTKKEKEELQANALSLDN<br>LKSILFDFLQKLKDFRNYYSHYRHSGSSELPLFDGNMLQRLYNV<br>FDVSVQRVKRDHEHNDKVDPHYHFNHLVRKGKKDRYGHNDN<br>PSFKHHFVDSEGMVTEAGLLFFVSLFLEKRDAIWMQKKIRGFK<br>GGTGPYEQMTNEVFCRSRISLPKLKLESLRTDDWMLLDMLNEL<br>VRCPKPLYDRLREKDRACFRVPVDILPDEDDTDGGGEDPFKNT<br>LVRHQDRFPYFALRYFDLKKVFTSLRFHIDLGTYHFAIYKKMIG<br>EQPEDRHLTRNLYGFGRIQDFAEEHRPEEWKRLVRDLDYLETG<br>DKPYISQTTPHYHIEKGKIGLRFVPEGQHLWPSPEVGTTRTGRSK<br>CAQDKRLTAEAFLSVHELMPMMFYYFLLREKYSEEVSAEKVQ<br>GRIKRVIEDVYAIYDAFARDEINTLKELDTCLADKGIRRGHLPK<br>QMITILSQERKDMKEKIRKKLQEMIADTDHRLDMLDRQTDRKI<br>RIGRKNAGLPKSGVIADWLVRDMMRFQPVAKDASGKPLNNSK<br>ANSTEYRMLQRALALFGGEKERLTPYFRQMNLTGGNNPHPFLH<br>ETRWESHTNILSFYRSYLRARKAFLERIGRSDRVENCPFLLLKEP<br>KTDRQTLVAGWKDEFHLPRGIFTEAVRDCLIEMGYDEVGSYRE<br>VGFMAKAVPLYFERACEDRVQPFYDSPFNVGNSLKPKKGRFLS<br>KEDRAEEWERGMERFRDLEAWSHSAARRIKDAFAGIEYASPGN<br>KKKIEQLLRDLSLWEAFESKLKVRADKINLAKLKKEILEAQEHP<br>YHDFKSWQKFERELRLVKNQDIITWMMCRDLMEENKVEGLDT<br>GTLYLKDIRPNVQEQGSLNVLNRVKPMRLPVVVYRADSRGHV<br>HKEAPLATVYIEERNTKLLKQGNFKSFVKDRRLNGLFSFVDTG<br>GLAMEQYPISKLRVEYELAKYQTARVCVFELTLRLEESLLSRYP<br>HLPDESFREMLESWSDPLLAKWPELHGKVRLLIAVRNAFSHNQ<br>YPMYDEAVFSSIRKYDPSSPDAIEERMGLNIAHRLSEEVKQAKE<br>TVERIIQA |
| *Porphyromonas gulae* (SEQ ID No. 173) | WP_039445055 | MNTVPATENKGQSRTVEDDPQYFGLYLNLARENLIEVESHVRI<br>KFGKKKLNEESLKQSLLCDHLLSIDRWTKVYGHSRRYLPFLHCF<br>DPDSGIEKDHDSKTGVDPDSAQRLIRELYSLLDFLRNDFSHNRL<br>DGTTFEHLKVSPDISSFITGAYTFACERAQSRFADFFKPDDFLLA<br>KNRKEQLISVADGKECLTVSGFAFFICLFLDREQASGMLSRIRGF<br>KRTDENWARAVHETFCDLCIRHPHDRLESSNTKEALLLDMLNE<br>LNRCPRILYDMLPEEERAQFLPALDENSMNNLSENSLNEESRLL<br>WDGSSDWAEALTKRIRHQDRFPYLMLRFIEEMDLLKGIRFRVD<br>LGEIELDSYSKKVGRNGEYDRTITDHALAFGKLSDFQNEEEVSR<br>MISGEASYPVRFSLFAPRYAIYDNKIGYCHTSDPVYPKSKTGEK<br>RALSNPQSMGFISVHDLRKLLLMELLCEGSFSRMQSDFLRKANR<br>ILDETAEGKLQFSALFPEMRHRFIPPQNPKSKDRREKAETTLEKY<br>KQEIKGRKDKLNSQLLSAFDMNQRQLPSRLLDEWMNIRPASHS<br>VKLRTYVKQLNEDCRLRLRKFRKDGDGKARAIPLVGEMATFLS<br>QDIVRMIISEETKKLITSAYYNEMQRSLAQYAGEENRRQFRAIV<br>AELHLLDPSSGHPFLSATMETAHRYTEDFYKCYLEKKREWLAK<br>TFYRPEQDENTKRRISVFFVPDGEARKLLPLLIRRRMKEQNDLQ<br>DWIRNKQAHPIDLPSHLFDSKIMELLKVKDGKKKWNEAFKDW<br>WSTKYPDGMQPFYGLRRELNIHGKSVSYIPSDGKKFADCYTHL<br>MEKTVRDKKRELRTAGKPVPPDLAAYIKRSFHRAVNEREFMLR<br>LVQEDDRLMLMAINKMMTDREEDILPGLKNIDSILDEENQFSLA<br>VHAKVLEKEGEGGDNSLSLVPATIEIKSKRKDWSKYIRYRYDR<br>RVPGLMSHFPEHKATLDEVKTLLGEYDRCRIKIFDWAFALEGAI<br>MSDRDLKPYLHESSSREGKSGEHSTLVKMLVEKKGCLTPDESQ<br>YLILIRNKAAHNQFPCAAEMPLIYRDVSAKVGSIEGSSAKDLPE<br>GSSLVDSLWKKYEMIIRKILPILDHENRFFGKLLNNMSQPINDL |
| *Capnocytophaga cynodegmi* (SEQ ID No. 174) | WP_041989581 | MENKTSLGNNIYYNPFKPQDKSYFAGYLNAAMENIDSVFRELG<br>KRLKGKEYTSENFFDAIFKENISLVEYERYVKLLSDYFPMARLL<br>DKKEVPIKERKENFKKNFRGIIKAVRDLRNFYTHKEHGEVEITD<br>EIFGVLDEMLKSTVLTVKKKKIKTDKTKEILKKSIEKQLDILCQK<br>KLEYLKDTARKIEEKRRNQRERGEKKLVPRFEYSDRRDDLIAAI<br>YNDAFDVYIDKKKDSLKESSKTKYNTESYPQQEEGDLKIPISKN |

TABLE 1-continued

| | | |
|---|---|---|
| | | GVVFLLSLFLSKQEVHAFKSKIAGFKATVIDEATVSHRKNSICF<br>MATHEIFSHLAYKKLKRKVRTAEINYSEAENAEQLSIYAKETLM<br>MQMLDELSKVPDVVYQNLSEDVQKTFIEDWNEYLKENNGDVG<br>TMEEEQVIHPVIRKRYEDKFNYFAIRFLDEFAQFPTLRFQVHLG<br>NYLHDSRPKEHLISDRRIKEKITVFGRLSELEHKKALFIKNTETN<br>EDRKHYWEVFPNPNYDFPKENISVNDKDFPIAGSILDREKQPTA<br>GKIGIKVNLLNQKYISEVDKAVKAHQLKQRNNKPSIQNIIEEIVPI<br>NGSNPKEIIVFGGQPTAYLSMNDIHSILYEFFDKWEKKKEKLEK<br>KGEKELRKEIGKELEEKIVGKIQTQIQQIIDKDINAKILKPYQDDD<br>STAIDKEKLIKDLKQEQKILQKLKNEQTAREKEYQECIAYQEES<br>RKIKRSDKSRQKYLRNQLKRKYPEVPTRKEILYYQEKGKVAVW<br>LANDIKRFMPTDFKNEWKGEQHSLLQKSLAYYEQCKEELKNLL<br>PQQKVFKHLPFELGGHFQQKYLYQFYTRYLDKRLEHISGLVQQ<br>AENFKNENKVFKKVENECFKFLKKQNYTHKGLDAQAQSVLGY<br>PIFLERGFMDEKPTIIKGKTFKGNESLFTDWFRYYKEYQNFQTF<br>YDTENYPLVELEKKQADRKRETKIYQQKKNDVFTLLMAKHIFK<br>SVFKQDSIDRFSLEDLYQSREERLENQEKAKQTGERNTNYIWNK<br>TVDLNLCDGKVTVENVKLKNVGNFIKYEYDQRVQTFLKYEENI<br>KWQAFLIKESKEEENYPYIVEREIEQYEKVRREELLKEVHLIEEY<br>ILEKVKDKEILKKGDNQNFKYYILNGLLKQLKNEDVESYKVFN<br>LNTKPEDVNINQLKQEATDLEQKAFVLTYIRNKFAHNQLPKKEF<br>WDYCQEKYGKIEKEKTYAEYFAEVFKREKEALMK |
| *Prevotella* sp. P5-119 (SEQ ID No. 175) | WP_042518169 | MNIPALVENQKKYFGTYSVMAMLNAQTVLDHIQKVADIEGEQ<br>NENNENLWFHPVMSHLYNAKNGYDKQPEKTMFIIERLQSYFPF<br>LKIMAENQREYSNGKYKQNRVEVNSNDIFEVLKRAFGVLKMY<br>RDLTNHYKTYEEKLIDGCEFLTSTEQPLSGMISKYYTVALRNTK<br>ERYGYKTEDLAFIQDNIKKITKDAYGKRKSQVNTGFFLSLQDYN<br>GDTQKKLHLSGVGIALLICLFLDKQYINIFLSRLPIFSSYNAQSEE<br>RRIIIRSFGINSIKLPKDRIHSEKSNKSVAMDMLNEVKRCPDELFT<br>TLSAEKQSRFRIISDDHNEVLMKRSTDRFVPLLLQYIDYGKLFD<br>HIRFHVNMGKLRYLLKADKTCIDGQTRVRVIEQPLNGFGRLEE<br>AETMRKQENGTFGNSGIRIRDFENVKRDDANPANYPYIVDTYT<br>HYILENNKVEMFISDKGSSAPLLPLIEDDRYVVKTIPSCRMSTLEI<br>PAMAFHMFLFGSKKTEKLIVDVHNRYKRLFQAMQKEEVTAENI<br>ASFGIAESDLPQKILDLISGNAHGKDVDAFIRLTVDDMLTDTER<br>RIKRFKDDRKSIRSADNKMGKRGFKQISTGKLADFLAKDIVLFQ<br>PSVNDGENKITGLNYRIMQSAIAVYDSGDDYEAKQQFKLMFEK<br>ARLIGKGTTEPHPFLYKVFARSIPANAVDFYERYLIERKFYLTGL<br>CNEIKRGNRVDVPFIRRDQNKWKTPAMKTLGRIYSEDLPVELPR<br>QMFDNEIKSHLKSLPQMEGIDFNNANVTYLIAEYMKRVLNDDF<br>QTFYQWKRNYHYMDMLKGEYDRKGSLQHCFTSVEEREGLWK<br>ERASRTERYRKLASNKIRSNRQMRNASSEEIETILDKRLSNCRNE<br>YQKSEKVIRRYRVQDALLFLLAKKTLTELADFDGERFKLKEIMP<br>DAEKGILSEIMPMSFTFEKGGKKYTITSEGMKLKNYGDFFVLAS<br>DKRIGNLLELVGSDIVSKEDIMEEFNKYDQCRPEISSIVFNLEKW<br>AFDTYPELSARVDREEKVDFKSILKILLNNKNINKEQSDILRKIR<br>NAFDHNNYPDKGIVEIKALPEIAMSIKKAFGEYAIMK |
| *Prevotella* sp. P4-76 (SEQ ID No. 176) | WP_044072147 | MNIPALVENQKKYFGTYSVMAMLNAQTVLDHIQKVADIEGEQ<br>NENNENLWFHPVMSHLYNAKNGYDKQPEKTMFIIERLQSYFPF<br>LKIMAENQREYSNGKYKQNRVEVNSNDIFEVLKRAFGVLKMY<br>RDQASHYKTYDEKLIDGCEFLTSTEQPLSGMINNYYTVALRNM<br>NERYGYKTEDLAFIQDKRFKFVKDAYGKKKSQVNTGFFLSLQD<br>YNGDTQKKLHLSGVGIALLICLFLDKQYINIFLSRLPIFSSYNAQS<br>EERRIIIRSFGINSIKQPKDRIHSEKSNKSVAMDMLNEIKRCPNEL<br>FETLSAEKQSRFRIISNDHNEVLMKRSSDRFVPLLLQYIDYGKLF<br>DHIRFHVNMGKLRYLLKADKTCIDGQTRVRVIEQPLNGFGRLE<br>EVETMRKQENGTFGNSGIRIRDFENMKRDDANPANYPYIVDTY<br>THYILENNKVEMFISDEETPAPLLPVIEDDRYVVKTIPSCRMSTL<br>EIPAMAFHMFLFGSKKTEKLIVDVHNRYKRLFKAMQKEEVTAE<br>NIASFGIAESDLPQKIIDLISGNAHGKDVDAFIRLTVDDMLADTE<br>RRIKRFKDDRKSIRSADNKMGKRGFKQISTGKLADFLAKDIVLF<br>QPSVNDGENKITGLNYRIMQSAIAVYNSGDDYEAKQQFKLMFE<br>KARLIGKGTTEPHPFLYKVFVRSIPANAVDFYERYLIERKFYLIG<br>LSNEIKKGNRVDVPFIRRDQNKWKTPAMKTLGRIYDEDLPVELP<br>RQMFDNEIKSHLKSLPQMEGIDFNNANVTYLIAEYMKRVLNDD<br>FQTFYQWKRNYRYMDMLRGEYDRKGSLQSCFTSVEEREGLWK<br>ERASRTERYRKLASNKIRSNRQMRNASSEEIETILDKRLSNSRNE<br>YQKSEKVIRRYRVQDALLFLLAKKTLTELADFDGERFKLKEIMP<br>DAEKGILSEIMPMSFTFEKGGKKYTITSEGMKLKNYGDFFVLAS<br>DKRIGNLLELVGSDTVSKEDIMEEFKKYDQCRPEISSIVFNLEKW<br>AFDTYPELSARVDREEKVDFKSILKILLNNKNINKEQSDILRKIR<br>NAFDHNNYPDKGVVEIRALPEIAMSIKKAFGEYAIMK |
| *Prevotella* sp. P5-60 (SEQ ID No. 177) | WP_044074780 | MNIPALVENQKKYFGTYSVMAMLNAQTVLDHIQKVADIEGEQ<br>NENNENLWFHPVMSHLYNAKNGYDKQPEKTMFIIERLQSYFPF<br>LKIMAENQREYSNGKYKQNRVEVNSNDIFEVLKRAFGVLKMY<br>RDLTNHYKTYEEKLIDGCEFLTSTEQPFSGMISKYYTVALRNTK<br>ERYGYKAEDLAFIQDNRYKFTKDAYGKRKSQVNTGSFLSLQDY |

TABLE 1-continued

| | | |
|---|---|---|
| | | NGDTTKKLHLSGVGIALLICLFLDKQYINLFLSRLPIFSSYNAQSE<br>ERRIIIRSFGINSIKQPKDRIHSEKSNKSVAMDMLNEVKRCPDELF<br>TTLSAEKQSRFRIISDDHNEVLMKRSSDRFVPLLLQYIDYGKLFD<br>HIRFHVNMGKLRYLLKADKTCIDGQTRVRVIEQPLNGFGRLEE<br>VETMRKQENGTFGNSGIRIRDFENMKRDDANPANYPYIVETYT<br>HYILENNKVEMFISDEENPTPLLPVIEDDRYVVKTIPSCRMSTLEI<br>PAMAFHMFLFGSEKTEKLIIDVHDRYKRLFQAMQKEEVTAENI<br>ASFGIAESDLPQKIMDLISGNAHGKDVDAFIRLTVDDMLTDTER<br>RIKRFKDDRKSIRSADNKMGKRGFKQISTGKLADFLAKDIVLFQ<br>PSVNDGENKITGLNYRIMQSAIAVYDSGDDYEAKQQFKLMFEK<br>ARLIGKGTTEPHPFLYKVFVRSIPANAVDFYERYLIERKFYLIGL<br>SNEIKKGNRVDVPFIRRDQNKWKTPAMKTLGRIYSEDLPVELPR<br>QMFDNEIKSHLKSLPQMEGIDFNNANVTYLIAEYMKRVLNDDF<br>QTFYQWKRNYRYMDMLRGEYDRKGSLQHCFTSIEEREGLWKE<br>RASRTERYRKLASNKIRSNRQMRNASSEEIETILDKRLSNCRNE<br>YQKSEKIIRRYRVQDALLFLLAKKTLTELADFDGERFKLKEIMP<br>DAEKGILSEIMPMSFTFEKGGKIYTITSGGMKLKNYGDFFVLAS<br>DKRIGNLLELVGSNTVSKEDIMEEFKKYDQCRPEISSIVFNLEKW<br>AFDTYPELPARVDRKEKVDFWSILDVLSNNKDINNEQSYILRKI<br>RNAFDHNNYPDKGIVEIKALPEIAMSIKKAFGEYAIMK |
| Phaeodactylibacter xiamenensis (SEQ ID No. 178) | WP_044218239 | MTNTPKRRTLHRHPSYFGAFLNIARHNAFMIMEHLSTKYDMED<br>KNTLDEAQLPNAKLFGCLKKRYGKPDVTEGVSRDLRRYFPFLN<br>YPLFLHLEKQQNAEQAATYDINPEDIEFTLKGFFRLLNQMRNNY<br>SHYISNTDYGKFDKLPVQDIYEAAIFRLLDRGKHTKRFDVFESK<br>HTRHLESNNSEYRPRSLANSPDHENTVAFVTCLFLERKYAFPFL<br>SRLDCFRSTNDAAEGDPLIRKASHECYTMFCCRLPQPKLESSDIL<br>LDMVNELGRCPSALYNLLSEEDQARFHIKREEITGFEEDPDEELE<br>QEIVLKRHSDRFPYFALRYFDDTEAFQTLRFDVYLGRWRTKPV<br>YKKRIYGQERDRVLTQSIRTFTRLSRLLPIYENVKHDAVRQNEE<br>DGKLVNPDVTSQFHKSWIQIESDDRAFLSDRIEHFSPHYNFGDQ<br>VIGLKFINPDRYAAIQNVFPKLPGEEKKDKDAKLVNETADAIIST<br>HEIRSLFLYHYLSKKPISAGDERRFIQVDTETFIKQYIDTIKLFFED<br>IKSGELQPIADPPNYQKNEPLPYVRGDKEKTQEERAQYRERQKE<br>IKERRKELNTLLQNRYGLSIQYIPSRLREYLLGYKKVPYEKLAL<br>QKLRAQRKEVKKRIKDIEKMRTPRVGEQATWLAEDIVFLTPPK<br>MHTPERKTTKHPQKLNNDQFRIMQSSLAYFSVNKKAIKKFFQK<br>ETGIGLSNRETSHPFLYRIDVGRCRGILDFYTGYLKYKMDWLDD<br>AIKKVDNRKHGKKEAKKYEKYLPSSIQHKTPLELDYTRLPVYLP<br>RGLFKKAIVKALAAHADFQVEPEEDNVIFCLDQLLDGDTQDFY<br>NWQRYYRSALTEKETDNQLVLAHPYAEQILGTIKTLEGKQKNN<br>KLGNKAKQKIKDELIDLKRAKRRLLDREQYLRAVQAEDRALW<br>LMIQERQKQKAEHEEIAFDQLDLKNITKILTESIDARLRIPDTKV<br>DITDKLPLRRYGDLRRVAKDRRLVNLASYYHVAGLSEIPYDLV<br>KKELEEYDRRRVAFFEHVYQFEKEVYDRYAAELRNENPKGEST<br>YFSHWEYVAVAVKHSADTHFNELFKEKVMQLRNKFHHNEFPY<br>FDWLLPEVEKASAALYADRVFDVAEGYYQKMRKLMRQ |
| *Flavobacterium* sp. 316 (SEQ ID No. 179) | WP_045968377 | MDNNITVEKTELGLGITYNHDKVEDKHYFGGFFNLAQNNIDLV<br>AQEFKKRLLIQGKDSINIFANYFSDQCSITNLERGIKILAEYFPVV<br>SYIDLDEKNKSKSIREHLILLLETINNLRNYYTHYYHKKIIIDGSL<br>FPLLDTILLKVVLEIKKKKLKEDKTKQLLKKGLEKEMTILFNLM<br>KAEQKEKKIKGWNIDENIKGAVLNRAFSHLLYNDELSDYRKSK<br>YNTEDETLKDTLTESGILFLLSFFLNKKEQEQLKANIKGYKGKIA<br>SIPDEEITLKNNSLRNMATHWTYSHLTYKGLKHRIKTDHEKETL<br>LVNMVDYLSKVPHEIYQNLSEQNKSLFLEDINEYMRDNEENHD<br>SSEASRVIHPVIRKRYENKFAYFAIRFLDEFAEFPTLRFMVNVGN<br>YIHDNRKKDIGGTSLITNRTIKQQINVFGNLTEIHKKKNDYFEKE<br>ENKEKTLEWELFPNPSYHFQKENIPIFIDLEKSKETNDLAKEYAK<br>EKKKIFGSSRKKQQNTAKKNRETIINLVFDKYKTSDRKTVTFEQ<br>PTALLSFNELNSFLYAFLVENKTGKELEKIIIEKIANQYQILKNCS<br>STVDKTNDNIPKSIKKIVNTTTDSFYFEGKKIDIEKLEKDITIEIEK<br>TNEKLETIKENEESAQNYKRNERNTQKRKLYRKYVFFTNEIGIE<br>ATWITNDILRFLDNKENWKGYQHSELQKFISQYDNYKKEALGL<br>LESEWNLESDAFFGQNLKRMFQSNSTFETFYKKYLDNRKNTLE<br>TYLSAIENLKTMTDVRPKVLKKKWTELFRFFDKKIYLLSTIETKI<br>NELITKPINLSRGIFEEKPTFINGKNPNKENNQHLFANWFIYAKK<br>QTILQDFYNLPLEQPKAITNLKKHKYKLERSINNLKIEDIYIKQM<br>VDFLYQKLFEQSFIGSLQDLYTSKEKREIEKGKAKNEQTPDESFI<br>WKKQVEINTHNGRIIAKTKIKDIGKFKNLLTDNKIAHLISYDDRI<br>WDFSLNNDGDITKKLYSINTELESYETIRREKLLKQIQQFEQFLL<br>EQETEYSAERKHPEKFEKDCNPNFKKYIIEGVLNKIIPNHEIEEIEI<br>LKSKEDVFKINFSDILILNNDNIKKGYLLIMIRNKFAHNQLIDKN<br>LFNFSLQLYSKNENENFSEYLNKVCQNIIQEFKEKLK |
| *Porphyromonas gulae* (SEQ ID No. 180) | WP_046201018 | MTEQSERPYNGTYYTLEDKHFWAAFLNLARHNAYITLTHIDRQ<br>LAYSKADITNDQDVLSFKALWKNFDNDLERKSRLRSLILKHFSF<br>LEGAAYGKKLFESKSSGNKSSKNKELTKKEKEELQANALSLDN<br>LKSILFDFLQKLKDFRNYYSHYRHSESSELPLFDGNMLQRLYNV<br>FDVSVQRVKRDHEHNDKVDPHRHFNHLVRKGKKDRYGHNDN |

TABLE 1-continued

| | | |
|---|---|---|
| | | PSFKHHFVDSEGMVTEAGLLFFVSLFLEKRDAIWMQKKIRGFK<br>GGTETYQQMTNEVFCRSRISLPKLKLESLRTDDWMLLDMLNEL<br>VRCPKPLYDRLREKDRARFRVPVDILPDEDDTDGGGEDPFKNT<br>LVRHQDRFPYFALRYFDLKKVFTSLRFHIDLGTYHFAIYKKMIG<br>EQPEDRHLTRNLYGFGRIQDFAEEHRPEEWKRLVRDLDYFETG<br>DKPYISQTTPHYHIEKGKIGLRFMPEGQHLWPSPEVGTTRTGRS<br>KYAQDKRLTAEAFLSVHELMPMMFYYFLLREKYSEEVSAEKV<br>QGRIKRVIEDVYAIYDAFARDEINTLKELDACLADKGIRRGHLP<br>KQMIAILSQEHKDMEEKIRKKLQEMIADTDHRLDMLDRQTDRK<br>IRIGRKNAGLPKSGVIADWLVRDMMRFQPVAKDTSGKPLNNSK<br>ANSTEYRMLQRALALFGGEKKRLTPYFRQMNLTGGNNPHPFLH<br>ETRWESHTNILSFYRSYLRARKAFLERIGRSDRMENRPFLLLKEP<br>KTDRQTLVAGWKSEFHLPRGIFTEAVRDCLIEMGYDEVGSYRE<br>VGFMAKAVPLYFERACEDRVQPFYDSPFNVGNSLKPKKGRFLS<br>KEERAEEWERGKERFRDLEAWSHSAARRIEDAFAGIEYASPGN<br>KKKIEQLLRDLSLWEAFESKLKVRADKINLAKLKKEILEAQEHP<br>YHDFKSWQKFERELRLVKNQDIITWMMCRDLMEENKVEGLDT<br>GTLYLKDIRPNVQEQGSLNVLNRVKPMRLPVVVYRADSRGHV<br>HKEEAPLATVYIEERDTKLLKQGNFKSFVKDRRLNGLFSFVDTG<br>GLAMEQYPISKLRVEYELAKYQTARVCVFELTLRLEESLLTRYP<br>HLPDESFRKMLESWSDPLLAKWPELHGKVRLLIAVRNAFSHNQ<br>YPMYDEAVFSSIRKYDPSSPDAIEERMGLNIAHRLSEEVKQAKE<br>TVERIIQV |
| WP_047431796<br>(SEQ<br>ID No.<br>181) | Chryseobacterium<br>sp.<br>YR477 | METQTIGHGIAYDHSKIQDKHFFGGFLNLAENNIKAVLKAFSEK<br>FNVGNVDVKQFADVSLKDNLPDNDFQKRVSFLKMYFPVVDFIN<br>IPNNRAKFRSDLTTLFKSVDQLRNFYTHYYHKPLDFDASLFILLD<br>DIFARTAKEVRDQKMKDDKTRQLLSKSLSEELQKGYELQLERL<br>KELNRLGKKVNIHDQLGIKNGVLNNAFNHLIYKDGESFKTKLT<br>YSSALTSFESAENGIEISQSGLLFLLSMFLKRKEIEDLKNRNKGF<br>KAKVVIDEDGKVNGLKFMATHWVFSYLCFKGLKSKLSTEFHEE<br>TLLIQIIDELSKVPDELYCAFDKETRDKFIEDINEYVKEGHQDFSL<br>EDAKVIHPVIRKRYENKFNYFAIRFLDEFVKFPSLRFQVHVGNY<br>VHDRRIKNIDGTTFETERVVKDRIKVFGRLSEISSYKAQYLSSVS<br>DKHDETGWEIFPNPSYVFINNNIPIHISVDTSFKKEIADFKKLRRA<br>QVPDELKIRGAEKKRKFEITQMIGSKSVLNQEEPIALLSLNEIPAL<br>LYEILINGKEPAEIERIIKDKLNERQDVIKNYNPENWLPASQISRR<br>LRSNKGERIINTDKLLQLVTKELLVTEQKLKIISDNREALKQKKE<br>GKYIRKFIFTNSELGREAIWLADDIKRFMPADVRKEWKGYQHS<br>QLQQSLAFYNSRPKEALAILESSWNLKDEKIIWNEWILKSFTQN<br>KFFDAFYNEYLKGRKKYFAFLSEHIVQYTSNAKNLQKFIKQQM<br>PKDLFEKRHYIIEDLQTEKNKILSKPFIFPRGIFDKKPTFIKGVKV<br>EDSPESFANWYQYGYQKDHQFQKFYDWKRDYSDVFLEHLGKP<br>FINNGDRRTLGMEELKERIIIKQDLKIKKIKIQDLFLRLIAENLFQ<br>KVFKYSAKLPLSDFYLTQEERMEKENMAALQNVREEGDKSPNI<br>IKDNFIWSKMIPYKKGQIIENAVKLKDIGKLNVLSLDDKVQTLL<br>SYDDAKPWSKIALENEFSIGENSYEVIRREKLFKEIQQFESEILFR<br>SGWDGINHPAQLEDNRNPKFKMYIVNGILRKSAGLYSQGEDIW<br>FEYNADFNNLDADVLETKSELVQLAFLVTAIRNKFAHNQLPAK<br>EFYFYIRAKYGFADEPSVALVYLNFTKYAINEFKKVMI |
| *Riemerella*<br>*anatipestifer*<br>(SEQ ID<br>No. 182) | WP_049354263 | MFFSFHNAQRVIFKHLYKAFDASLRMVKEDYKAHFTVNLTRDF<br>AHLNRKGKNKQDNPDFNRYRFEKDGFFTESGLLFFTNLFLDKR<br>DAYWMLKKVSGFKASHKQREKMTTEVFCRSRILLPKLRLESRY<br>DHNQMLLDMLSELSRCPKLLYEKLSEENKKHFQVEADGFLDEI<br>EEEQNPFKDTLIRHQDRFPYFALRYLDLNESFKSIRFQVDLGTYH<br>YCIYDKKIGDEQEKRHLTRTLLSFGRLQDFTEINRPQEWKALTK<br>DLDYKETSNQPFISKTTPHYHITDNKIGFRLGTSKELYPSLEIKDG<br>ANRIAKYPYNSGFVAHAFISVHELLPLMFYQHLTGKSEDLLKET<br>VRHIQRIYKDFEEERINTIEDLEKANQGRLPLGAFPKQMLGLLQ<br>NKQPDLSEKAKIKIEKLIAETKLLSHRLNTKLKSSPKLGKRREKL<br>IKTGVLADWLVKDFMRFQPVAYDAQNQPIKSSKANSTEFWFIR<br>RALALYGGEKNRLEGYFKQTNLIGNTNPHPFLNKFNWKACRNL<br>VDFYQQYLEQREKFLEAIKNQPWEPYQYCLLLKIPKENRKNLV<br>KGWEQGGISLPRGLFTEAIRETLSEDLMLSKPIRKEIKKHGRVGF<br>ISRAITLYFKEKYQDKHQSFYNLSYKLEAKAPLLKREEHYEYW<br>QQNKPQSPTESQRLELHTSDRWKDYLLYKRWQHLEKKLRLYR<br>NQDVMLWLMTLELTKNHFKELNLNYHQLKLENLAVNVQEAD<br>AKLNPLNQTLPMVLPVKVYPATAFGEVQYHKTPIRTVYIREEHT<br>KALKMGNFKALVKDRRLNGLFSFIKEENDTQKHPISQLRLRREL<br>EIYQSLRVDAFKETLSLEEKLLNKHTSLSSLENEFRALLEEWKK<br>EYAASSMVTDEHIAFIASVRNAFCHNQYPFYKEALHAPIPLFTV<br>AQPTTEEKDGLGIAEALLKVLREYCEIVKSQI |
| *Porphyromonas*<br>*gingivalis*<br>(SEQ ID<br>No. 183) | WP_052912312 | MTEQNEKPYNGTYYTLEDKHFWAAFFNLARHNAYITLAHIDRQ<br>LAYSKADITNDEDILFFKGQWKNLDNDLERKARLRSLILKHFSF<br>LEGAAYGKKLFESQSSGNKSSKKKELTKKEKEELQANALSLDN<br>LKSILFDFLQKLKDFRNYYSHYRHPESSELPLFDGNMLQRLYNV<br>FDVSVQRVKRDHEHNDKVDPHRHFNHLVRKGKKDKYGNNDN<br>PFFKHHFVDREEKVTEAGLLFFVSLFLEKRDAIWMQKKIRGFKG |

TABLE 1-continued

| | | |
|---|---|---|
| | | GTEAYQQMTNEVFCRSRISLPKLKLESLRTDDWMLLDMLNELV<br>RCPKLLYDRLREEDRARFRVPVDILSDEDDTDGTEEDPFKNTLV<br>RHQDRFPYFALRYFDLKKVFTSLRFHIDLGTYHFAIYKKNIGEQ<br>PEDRHLTRNLYGFGRIQDFAEEHRPEEWKRLVRDLDYFETGDK<br>PYITQTTPHYHIEKGKIGLRFVPEGQLLWPSPEVGATRTGRSKY<br>AQDKRFTAEAFLSVHELMPMMFYYFLLREKYSEEASAEKVQG<br>RIKRVIEDVYAVYDAFARDEINTRDELDACLADKGIRRGHLPRQ<br>MIAILSQEHKDMEEKVRKKLQEMIADTDHRLDMLDRQTDRKIR<br>IGRKNAGLPKSGVIADWLVRDMMRFQPVAKDTSGKPLNNSKA<br>NSTEYRMLQRALALFGGEKERLTPYFRQMNLTGGNNPHPFLHE<br>TRWESHTNILSFYRSYLKARKAFLQSIGRSDREENHRFLLLKEPK<br>TDRQTLVAGWKSEFHLPRGIFTEAVRDCLIEMGYDEVGSYKEV<br>GFMAKAVPLYFERACKDRVQPFYDYPFNVGNSLKPKKGRFLSK<br>EKRAEEWESGKERFRDLEAWSHSAARRIEDAFVGIEYASWENK<br>KKIEQLLQDLSLWETFESKLKVKADKINIAKLKKEILEAKEHPY<br>HDFKSWQKFERELRLVKNQDIITWMMCRDLMEENKVEGLDTG<br>TLYLKDIRTDVQEQGSLNVLNHVKPMRLPVVVYRADSRGHVH<br>KEEAPLATVYIEERDTKLLKQGNFKSFVKDRRLNGLFSFVDTGA<br>LAMEQYPISKLRVEYELAKYQTARVCAFEQTLELEESLLTRYPH<br>LPDESFREMLESWSDPLLDKWPDLQREVRLLIAVRNAFSHNQY<br>PMYDETIFSSIRKYDPSSLDAIEERMGLNIAHRLSEEVKLAKEMV<br>ERIIQA |
| *Porphyromonas gingivalis* (SEQ ID No. 184) | WP_058019250 | MTEQNEKPYNGTYYTLKDKHFWAAFFNLARHNAYITLTHIDRQ<br>LAYSKADITNDEDILFFKGQWKNLDNDLERKARLRSLILKHFSF<br>LEGAAYGKKLFESQSSGNKSSKKKELTKKEKEELQANALSLDN<br>LKSILFDFLQKLKDFRNYYSHYRHPESSELPMFDGNMLQRLYN<br>VFDVSVQRVKRDHEHNDKVDPHRHFNHLVRKGKKDRCGNND<br>NPFFKHHFVDREGKVTEAGLLFFVSLFLEKRDAIWMQKKIRGF<br>KGGTETYQQMTNEVFCRSRISLPKLKLESLRTDDWMLLDMLNE<br>LVRCPKSLYDRLREEDRACFRVPVDILSDEDDTDGAEEDPFKNT<br>LVRHQDRFPYFALRYFDLKKVFTSLRFHIDLGTYHFAIYKKNIG<br>EQPEDRHLTRNLYGFGRIQDFAEEHRPEEWKRLVRDLDCFETG<br>DKPYITQTTPHYHIEKGKIGLRFVPEGQHLWPSPEVGATRTGRS<br>KYAQDKRFTAEAFLSVHELMPMMFYYFLLREKYSEEVSAERV<br>QGRIKRVIEDVYAVYDAFARDEINTRDELDACLADKGIRRGHLP<br>RQMIAILSQKHKDMEEKVRKKLQEMIADTDHRLDMLDRQTDR<br>KIRIGRKNAGLPKSGVIADWLVRDMMRFQPVAKDTSGKPLNNS<br>KANSTEYRMLQRALALFGGEKERLTPYFRQMNLTGGNNPHPFL<br>HETRWESHTNILSFYRSYLKARKAFLQSIGRSDRVENHRFLLLK<br>EPKTDRQTLVAGWKGEFHLPRGIFTEAVRDCLIEMGLDEVGSY<br>KEVGFMAKAVPLYFERACKDRVQPFYDYPFNVGNSLKPKKGR<br>FLSKEKRAEEWESGKERFRDLEAWSHSAARRIEDAFAGIENASR<br>ENKKKIEQLLQDLSLWETFESKLKVKADKINIAKLKKEILEAKE<br>HPYLDFKSWQKFERELRLVKNQDIITWMMCRDLMEENKVEGL<br>DTGTLYLKDIRTDVQEQGSLNVLNHVKPMRLPVVVYRADSRG<br>HVHKEQAPLATVYIEERDTKLLKQGNFKSFVKDRRLNGLFSFV<br>DTGALAMEQYPISKLRVEYELAKYQTARVCAFEQTLELEESLLT<br>RYPHLPDENFRKMLESWSDPLLDKWPDLHRKVRLLIAVRNAFS<br>HNQYPMYDEAVFSSIRKYDPSSPDAIEERMGLNIAHRLSEEVKQ<br>AKEMAERIIQA |
| *Flavobacterium columnare* (SEQ ID No. 185) | WP_060381855 | MSSKNESYNKQKTFNHYKQEDKYFFGGFLNNADDNLRQVGKE<br>FKTRINFHNNNELASVFKDYFNKEKSVAKREHALNLLSNYFP<br>VLERIQKHTNHNFEQTREIFELLLDTIKKLRDYYTHHYHKPITIN<br>PKVYDFLDDTLLDVLITIKKKKVKNDTSRELLKEKFRPELTQLK<br>NQKREELIKKGKKLLEENLENAVFNHCLRPFLEENKTDDKQNK<br>TVSLRKYRKSKPNEETSITLTQSGLVFLISFFLHRKEFQVFTSGLE<br>GFKAKVNTIKEEEISLNKNNIVYMITHWSYSYYNFKGLKHRIKT<br>DQGVSTLEQNNTTHSLTNTNTKEALLTQIVDYLSKVPNEIYETL<br>SEKQQKEFEEDINEYMRENPENEDSTFSSIVSHKVIRKRYENKFN<br>YFAMRFLDEYAELPTLRFMVNFGDYIKDRQKKILESIQFDSERII<br>KKEIHLFEKLGLVTEYKKNVYLKETSNIDLSRFPLFPSPSYVMA<br>NNNIPFYIDSRSNNLDEYLNQKKKAQSQNRKRNLTFEKYNKEQ<br>SKDAIIAMLQKEIGVKDLQQRSTIGLLSCNELPSMLYEVIVKDIK<br>GAELENKIAQKIREQYQSIRDFTLDSPQKDNIPTTLTKTISTDTSV<br>TFENQPIDIPRLKNALQKELTLTQEKLLNVKQHEIEVDNYNRNK<br>NTYKFKNQPKDKVDDNKLQRKYVFYRNEIGQEANWLASDLIH<br>FMKNKSLWKGYMHNELQSFLAFFEDKKNDCIALLETVFNLKED<br>CILTKDLKNLFLKHGNFIDFYKEYLKLKEDFLNTESTFLENGFIG<br>LPPKILKKELSKRLNYIFIVFQKRQFIIKELEEKKNNLYADAINLS<br>RGIFDEKPTMIPFKKPNPDEFASWFVASYQYNNYQSFYELTPDK<br>IENDKKKKYKNLRAINKVKIQDYYLKLMVDTLYQDLFNQPLDK<br>SLSDFYVSKTDREKIKADAKAYQKRNDSFLWNKVIHLSLQNNR<br>ITANPKLKDIGKYKRALQDEKIATLLTYDDRTWTYALQKPEKE<br>NENDYKELHYTALNMELQEYEKVRSKKLLKQVQELEKQILDKF<br>YDFSNNATHPEDLEIEDKKGKRHPNFKLYITKALLKNESEIINLE<br>NIDIEILIKYYDYNTEKLKEKIKNMDEDEKAKIVNTKENYNKITN<br>VLIKKALVLIIIRNKMAHNQYPPKFIYDLATRFVPKKEEEYFACY<br>FNRVFETITTELWENKKKAKEIV |

TABLE 1-continued

| | | |
|---|---|---|
| *Porphyromonas gingivalis* (SEQ ID No. 186) | WP_061156470 | MTEQNERPYNGTYYTLEDKHFWAAFFNLARHNAYITLTHIDRQ LAYSKADITNDEDILFFKGQWKNLDNDLERKARLRSLILKHFSF LEGAAYGKKLFENKSSGNKSSKKKELTKKEKEELQANALSLDN LKSILFDFLQKLKDFRNYYSHYRHPESSELPLFDGNMLQRLYNV FDVSVQRVKRDHEHNDKVDPHRHFNHLVRKGKKDRCGNNDN PFFKHHFVDREGKVTEAGLLFFVSLFLEKRDAIWMQKKIRGFK GGTEAYQQMTNEVFCRSRISLPKLKLESLRTDDWMLLDMLNEL VRCPKSLYDRLREEDRARFRVPVDILSDEDDTDGTEEDPFKNTL VRHQDRFPYFALRYFDLKKVFTSLRFHIDLGTYHFAIYKKNIGE QPEDRHLTRNLYGFGRIQDFAEEHRPEEWKRLVRDLDYFETGD KPYITQTTPHYHIEKGKIGLRFVPEGQHLWPSPEVGATRTGRSK YAQDKRLTAEAFLSVHELMPMMFYYFLLREKYSEEVSAEKVQ GRIKRVIEDVYAVYDAFARGEIDTLDRLDACLADKGIRRGHLPR QMIAILSQEHKDMEEKVRKKLQEMIADTDHRLDMLDRQTDRKI RIGRKNAGLPKSGVIADWLVRDMMRFQPVAKDTSGKPLNNSK ANSTEYRMLQRALALFGGEKERLTPYFRQMNLTGGNNPHPFLH ETRWESHTNILSFYRSYLKARKAFLQSIGRSDREENHRFLLLKEP KTDRQTLVAGWKSEFHLPRGIFTEAVRDCLIEMGYDEVGSYKE VGFMAKAVPLYFERACKDRVQPFYDYPFNVGNSLKPKKGRFLS KEKRAEEWESGKERFRLAKLKKEILEAKEHPYLDFKSWQKFER ELRLVKNQDIITWMMCRDLMEENKVEGLDTGTLYLKDIRTEVQ EQGSLNVLNRVKPMRLPVVVYRADSRGHVHKEQAPLATVYIEE RDTKLLKQGNFKSFVKDRRLNGLFSFVDTGGLAMEQYPISKLR VEYELAKYQTARVCAFEQTLELEESLLTRCPHLPDKNFRKMLES WSDPLLDKWPDLQREVWLLIAVRNAFSHNQYPMYDEAVFSSIR KYDPSSPDAIEERMGLNIAHRLSEEVKQAKEMAERIIQA |
| *Porphyromonas gingivalis* (SEQ ID No. 187) | WP_061156637 | MNTVPASENKGQSRTVEDDPQYFGLYLNLARENLIEVESHVRIK FGKKKLNEESLKQSLLCDHLLSVDRWTKVYGHSRRYLPFLHYF DPDSQIEKDHDSKTGVDPDSAQRLIRELYSLLDFLRNDFSHNRL DGTTFEHLEVSPDISSFITGTYSLACGRAQSRFADFFKPDDFVLA KNRKEQLISVADGKECLTVSGLAFFICLFLDREQASGMLSRIRGF KRTDENWARAVHETFCDLCIRHPHDRLESSNTKEALLLDMLNE LNRCPRILYDMLPEEERAQFLPALDENSMNNLSENSLNEESRLL WDGSSDWAEALTKRIRHQDRFPYLMLRFIEEMDLLKGIRFRVD LGEIELDSYSKKVGRNGEYDRTITDHALAFGKLSDFQNEEEVSR MISGEASYPVRFSLFAPRYAIYDNKIGYCHTSDPVYPKSKTGEK RALSNPQSMGFISVHDLRKLLLMELLCEGSFSRMQSGFLRKANR ILDETAEGKLQFSALFPEMRHRFIPPQNPKSKDRREKAETTLEKY KQEIKGRKDKLNSQLLSAFDMNQRQLPSRLLDEWMNIRPASHS VKLRTYVKQLNEDCRLRLRKFRKDGDGKARAIPLVGEMATFLS QDIVRMIISEETKKLITSAYYNEMQRSLAQYAGEENRRQFRAIV AELHLLDPSSGHPFLSATMETAHRYTEDFYKCYLEKKREWLAK TFYRPEQDENTKRRISVFFVPDGEARKLLPLLIRRRMKEQNDLQ DWIRNKQAHPIDLPSHLFDSKIMELLKVKDGKKKWNEAFKDW WSTKYPDGMQPFYGLRRELNIHGKSVSYIPSDGKKFADCYTHL MEKTVQDKKRELRTAGKPVPPDLAADIKRSFHRAVNEREFMLR LVQEDDRLMLMAINKMMTDREEDILPGLKNIDSILDKENQFSLA VHAKVLEKEGEGGDNSLSLVPATIEIKSKRKDWSKYIRYRYDR RVPGLMSHFPEHKATLDEVKTLLGEYDRCRIKIFDWAFALEGAI MSDRDLKPYLHESSSREGKSGEHSTLVKMLVEKKGCLTPDESQ YLILIRNKAAHNQFPCAAEMPLIYRDVSAKVGSIEGSSAKDLPE GSSLVDSLWKKYEMIIRKILPILDPENRFFGKLLNNMSQPINDL |
| *Riemerella anatipestifer* (SEQ ID No. 188) | WP_061710138 | MFFSFHNAQRVIFKHLYKAFDASLRMVKEDYKAHFTVNLTRDF AHLNRKGKNKQDNPDFNRYRFEKDGFFTESGLLFFTNLFLDKR DAYWMLKKVSGFKASHKQSEKMTTEVFCRSRILLPKLRLESRY DHNQMLLDMLSELSRCPKLLYEKLSEKDKKCFQVEADGFLDEI EEEQNPFKDTLIRHQDRFPYFALRYLDLNESFKSIRFQVDLGTYH YCIYDKKIGYEQEKRHLTRTLLNFGRLQDFTEINRPQEWKALTK DLDYNETSNQPFISKTTPHYHITDNKIGFRLRTSKELYPSLEVKD GANRIAKYPYNSDFVAHAFISISVHELLPLMFYQHLTGKSEDLL KETVRHIQRIYKDFEEERINTIEDLEKANQGRLPLGAFPKQMLGL LQNKQPDLSEKAKIKIEKLIAETKLLSHRLNTKLKSSPKLGKRRE KLIKTGVLADWLVKDFMRFQPVVYDAQNQPIKSSKANSTESRLI RRALALYGGEKNRLEGYFKQTNLIGNTNPHPFLNKFNWKACRN LVDFYQQYLEQREKFLEAIKHQPWEPYQYCLLLKVPKENRKNL VKGWEQGGISLPRGLFTEAIRETLSKDLTLSKPIRKEIKKHGRVG FISRAITLYFKEKYQDKHQSFYNLSYKLEAKAPLLKKEEHYEYW QQNKPQSPTESQRLELHTSDRWKDYLLYKRWQHLEKKLRLYR NQDIMLWLMTLELTKNHFKELNLNYHQLKLENLAVNVQEADA KLNPLNQTLPMVLPVKVYPTTAFGEVQYHETPIRTVYIREEQTK ALKMGNFKALVKDRHLNGLFSFIKEENDTQKHPISQLRLRRELE IYQSLRVDAFKETLSLEEKLLNKHASLSSLENEFRTLLEEWKKK YAASSMVTDKHIAFIASVRNAFCHNQYPFYKETLHAPILLFTVA QPTTEEKDGLGIAEALLRVLREYCEIVKSQI |
| *Flavobacterium columnare* | WP_063744070 | MSSKNESYNKQKTFNHYKQEDKYFFGGFLNNADDNLRQVGKE FKTRINFNHNNNELASVFKDYFNKEKSVAKREHALNLLSNYFP |

TABLE 1-continued

| | | |
|---|---|---|
| (SEQ ID No. 189) | | VLERIQKHTNHNFEQTREIFELLLDTIKKLRDYYTHHYHKPITIN PKIYDFLDDTLLDVLITIKKKKVKNDTSRELLKEKLRPELTQLKN QKREELIKKGKKLLEENLENAVFNHCLRPFLEENKTDDKQNKT VSLRKYRKSKPNEETSITLTQSGLVFLMSFFLHRKEFQVFTSGLE GFKAKVNTIKEEKISLNKNNIVYMITHWSYSYYNFKGLKHRIKT DQGVSTLEQNNTTHSLTNTNTKEALLTQIVDYLSKVPNEIYETL SEKQQKEFEEDINEYMRENPENEDSTFSSIVSHKVIRKRYENKFN YFAMRFLDEYAELPTLRFMVNFGDYIKDRQKKILESIQFDSERII KKEIHLFEKLGLVTEYKKNVYLKETSNIDLSRFPLFPSPSYVMA NNNIPFYIDSRSNNLDEYLNQKKKAQSQNRKRNLTFEKYNKEQ SKDAIIAMLQKEIGVKDLQQRSTIGLLSCNELPSMLYEVIVKDIK GAELENKIAQKIREQYQSIRDFTLNSPQKDNIPTTLIKTISTDTSV TFENQPIDIPRLKNAIQKELALTQEKLLNVKQHEIEVNNYNRNK NTYKFKNQPKDKVDDNKLQRKYVFYRNEIGQEANWLASDLIH FMKNKSLWKGYMHNELQSFLAFFEDKKNDCIALLETVFNLKED CILTKDLKNLFLKHGNFIDFYKEYLKLKEDFLNTESTFLENGFIG LPPKILKKELSKRLNYIFIVFQKRQFIIKELEEKKNNLYADAINLS RGIFDEKPTMIPFKKPNPDEFASWFVASYQYNNYQSFYELTPDK IENDKKKKYKNLRAINKVKIQDYYLKLMVDTLYQDLFNQPLDK SLSDFYVSKTDREKIKADAKAYQKRNDSFLWNKVIHLSLQNNR ITANPKLKDIGKYKRALQDEKIATLLTYDDRTWTYALQKPEKE NENDYKELHYTALNMELQEYEKVRSKKLLKQVQELEKQILDKF YDFSNNATHPEDLEIEDKKGKRHPNFKLYITKALLKNESEIINLE NIDIEILIKYYDYNTEKLKEKIKNMDEDEKAKIVNTKENYNKITN VLIKKALVLIIIRNKMAHNQYPPKFIYDLATRFVPKKEEEYFACY FNRVFETITTELWENKKKAKEIV |
| *Riemerella anatipestifer* (SEQ ID No. 190) | WP_064970887 | MEKPLPPNVYTLKHKFFWGAFLNIARHNAFITICHINEQLGLTTP PNDDKIADVVCGTWNNILNNDHDLLKKSQLTELILKHFPFLAA MCYHPPKKEGKKKGSQKEQQKEKENEAQSQAEALNPSELIKVL KTLVKQLRTLRNYYSHHSHKKPDAEKDIFKHLYKAFDASLRMV KEDYKAHFTVNLTQDFAHLNRKGKNKQDNPDFDRYRFEKDGF FTESGLLFFTNLFLDKRDAYWMLKKVSGFKASHKQSEKMTTEV FCRSRILLPKLRLESRYDHNQMLLDMLSELSRYPKLLYEKLSEE DKKRFQVEADGFLDEIEEEQNPFKDTLIRHQDRFPYFALRYLDL NESFKSIRFQVDLGTYHYCIYDKKIGDEQEKRHLTRTLLSFGRL QDFTEINRPQEWKALTKDLDYKETSKQPFISKTTPHYHITDNKIG FRLGTSKELYPSLEVKDGANRIAQYPYNSDFVAHAFISVHELLP LMFYQHLTGKSEDLLKETVRHIQRIYKDFEEERINTIEDLEKANQ GRLPLGAFPKQMLGLLQNKQPDLSEKAKIKIEKLIAETKLLSHR LNTKLKSSPKLGKRREKLIKTGVLADWLVKDFMRFQPVAYDA QNQPIESSKANSTEFQLIQRALALYGGEKNRLEGYFKQTNLIGN TNPHPFLNKFNWKACRNLVDFYQQYLEQREKFLEAIKNQPWEP YQYCLLLKIPKENRKNLVKGWEQGGISLPRGLFTEAIRETLSKD LTLSKPIRKEIKKHGRVGFISRAITLYFREKYQDDHQSFYDLPYK LEAKASPLPKKEHYEYWQQNKPQSPTELQRLELHTSDRWKDYL LYKRWQHLEKKLRLYRNQDVMLWLMTLELTKNHFKELNLNY HQLKLENLAVNVQEADAKLNPLNQTLPMVLPVKVYPATAFGE VQYQETPIRTVYIREEQTKALKMGNFKALVKDRRLNGLFSFIKE ENDTQKHPISQLRLRRELEIYQSLRVDAFKETLNLEEKLLKKHTS LSSVENKFRILLEEWKKEYAASSMVTDEHIAFIASVRNAFCHNQ YPFYEEALHAPIPLFTVAQQTTEEKDGLGIAEALLRVLREYCEIV KSQI |
| Sinomicrobium oceani (SEQ ID No. 191) | WP_072319476.1 | MESTTTLGLHLKYQHDLFEDKHYFGGGVNLAVQNIESIFQAFA ERYGIQNPLRKNGVPAINNIFHDNISISNYKEYLKFLKQYLPVVG FLEKSNEINIFEFREDFEILINAIYKLRHFYTHYYHSPIKLEDRFYT CLNELFVAVAIQVKKHKMKSDKTRQLLNKNLHQLLQQLIEQKR EKLKDKKAEGEKVSLDTKSIENAVLNDAFVHLLDKDENIRLNY SSRLSEDIITKNGITLSISGLLFLLSLFLQRKEAEDLRSRIEGFKGK GNELRFMATHWVFSYLNVKRIKHRLNTDFQKETLLIQIADELSK VPDEVYKTLDHENRSKFLEDINEYIREGNEDASLNESTVVHGVI RKRYENKFHYLVLRYLDEFVDFPSLRFQVHLGNYIHDRRDKVI DGTNFITNRVIKEPIKVFGKLSHVSKLKSDYMESLSREHKNGWD VFPNPSYNFVGHNIPIFINLRSASSKGKELYRDLMKIKSEKKKKS REEGIPMERRDGKPTKIEISNQIDRNIKDNNFKDIYPGEPLAMLS LNELPALLFELLRRPSITPQDIEDRMVEKLYERFQIIRDYKPGDG LSTSKISKKLRKADNSTRLDGKKLLRAIQTETRNAREKLHTLEE NKALQKNRKRRTVYTTREQGREASWLAQDLKRFMPIASRKEW RGYHHSQLQQILAFYDQNPKQPLELLEQFWDLKEDTYVWNSWI HKSLSQHNGFVPMYEGYLKGRLGYYKKLESDIIGFLEEHKVLK RYYTQQHLNVIFRERLYFIKTETKQKLELLARPLVFPRGIFDDKP TFVQDKKVVDHPELFADWYVYSYKDDHSFQEFYHYKRDYNEI FETELSWDIDFKDNKRQLNPSEQMDLFRMKWDLKIKKIKIQDIF LKIVAEDIYLKIFGHKIPLSLSDFYISRQERLTLDEQAVAQSMRLP GDTSENQIKESNLWQTTVPYEKEQIREPKIKLKDIGKFKYFLQQ QKVLNLLKYDPQHVWTKAELEEELYIGKHSYEVVRREMLLQK CHQLEKHILEQFRFDGSNHPRELEQGNHPNFKMYIVNGILTKRG |

TABLE 1-continued

| | | |
|---|---|---|
| | | ELEIEAENWWLELGNSKNSLDKVEVELLTMKTIPEQKAFLLILIR<br>NKFAHNQLPADNYFHYASNLMNLKKSDTYSLFWFTVADTIVQ<br>EFMSL |
| Reichenbachiella agariperforans (SEQ ID No. 192) | WP_073124441.1 | MKTNPLIASSGEKPNYKKFNTESDKSFKKIFQNKGSIAPIAEKAC<br>KNFEIKSKSPVNRDGRLHYFSVGHAFKNIDSKNVFRYELDESQM<br>DMKPTQFLALQKEFFDFQGALNGLLKHIRNVNSHYVHTFEKLEI<br>QSINQKLITFLIEAFELAVIHSYLNEEELSYEAYKDDPQSGQKLV<br>QFLCDKFYPNKEHEVEERKTILAKNKRQALEHLLFIEVTSDIDW<br>KLFEKHKVFTISNGKYLSFHACLFLLSLFLYKSEANQLISKIKGF<br>KRNDDNQYRSKRQIFTFFSKKFTSQDVNSEEQHLVKFRDVIQYL<br>NHYPSAWNKHLELKSGYPQMTDKLMRYIVEAEIYRSFPDQTDN<br>HRFLLFAIREFFGQSCLDTWTGNTPINFSNQEQKGFSYEINTSAEI<br>KDIETKLKALVLKGPLNFKEKKEQNRLEKDLRREKKEQPTNRV<br>KEKLLTRIQHNMLYVSYGRNQDRFMDFAARFLAETDYFGKDA<br>KFKMYQFYTSDEQRDHLKEQKKELPKKEFEKLKYHQSKLVDY<br>FTYAEQQARYPDWDTPFVVENNAIQIKVTLFNGAKKIVSVQRN<br>LMLYLLEDALYSEKRENAGKGLISGYFVHHQKELKDQLDILEK<br>ETEISREQKREFKKLLPKRLLHRYSPAQINDTTEWNPMEVILEEA<br>KAQEQRYQLLLEKAILHQTEEDFLKRNKGKQFKLRFVRKAWH<br>LMYLKELYMNKVAEHGHHKSFHITKEEFNDFCRWMFAFDEVP<br>KYKEYLCDYFSQKGFFNNAEFKDLIESSTSLNDLYEKTKQRFEG<br>WSKDLTKQSDENKYLLANYESMLKDDMLYVNISHFISYLESKG<br>KINRNAHGHIAYKALNNVPHLIEEYYYKDRLAPEEYKSHGKLY<br>NKLKTVKLEDALLYEMAMHYLSLEPALVPKVKTKVKDILSSNI<br>AFDIKDAAGHHLYHLLIPFHKIDSFVALINHQSQQEKDPDKTSFL<br>AKIQPYLEKVKNSKDLKAVYHYYKDTPHTLRYEDLNMIHSHIV<br>SQSVQFTKVALKLEEYFIAKKSITLQIARQISYSEIADLSNYFTDE<br>VRNTAFHFDVPETAYSMILQGIESEFLDREIKPQKPKSLSELSTQ<br>QVSVCTAFLETLHNNLFDRKDDKKERLSKARERYFEQIN |

In certain example embodiments, the CRISPR effector protein is a Cas13a protein selected from Table 2.

TABLE 2

| | | | |
|---|---|---|---|
| c2c2-5 | 1 | Lachnospiraceae bacterium MA2020 (SEQ ID No. 193) | MQISKVNHKHVAVGQKDRERITGFIYNDPVGDEKSLEDVVA<br>KRANDTKVLFNVFNTKDLYDSQESDKSEKDKEIISKGAKFV<br>AKSFNSAITILKKQNKIYSTLTSQQVIKELKDKFGGARIYDDD<br>IEEALTETLKKSFRKENVRNSIKVLIENAAGIRSSLSKDEEELI<br>QEYFVKQLVEEYTKTKLQKNVVKSIKNQNMVIQPDSDSQVL<br>SLSESRREKQSSAVSSDTLVNCKEKDVLKAFLTDYAVLDEDE<br>RNSLLWKLRNLVNLYFYGSESIRDYSYTKEKSVWKEHDEQK<br>ANKTLFIDEICHITKIGKNGKEQKVLDYEENRSRCRKQNINY<br>YRSALNYAKNNTSGIFENEDSNHFWIHLIENEVERLYNGIEN<br>GEEFKFETGYISEKVWKAVINHLSIKYIALGKAVYNYAMKEL<br>SSPGDIEPGKIDDSYINGITSFDYEIIKAEESLQRDISMNVVFAT<br>NYLACATVDTDKDFLLFSKEDIRSCTKKDGNLCKNIMQFWG<br>GYSTWKNFCEEYLKDDKDALELLYSLKSMLYSMRNSSFHFS<br>TENVDNGSWDTELIGKLFEEDCNRAARIEKEKFYNNNLHMF<br>YSSSLLEKVLERLYSSHHERASQVPSFNRVFVRKNFPSSLSEQ<br>RITPKFTDSKDEQIWQSAVYYLCKEIYYNDFLQSKEAYKLFR<br>EGVKNLDKNDINNQKAADSFKQAVVYYGKAIGNATLSQVC<br>QAIMTEYNRQNNDGLKKKSAYAEKQNSNKYKHYPLFLKQV<br>LQSAFWEYLDENKEIYGFISAQIHKSNVEIKAEDFIANYSSQQ<br>YKKLVDKVKKTPELQKWYTLGRLINPRQANQFLGSIRNYVQ<br>FVKDIQRRAKENGNPIRNYYEVLESDSIIKILEMCTKLNGTTS<br>NDIHDYFRDEDEYAEYISQFVNFGDVHSGAALNAFCNSESEG<br>KKNGIYYDGINPIVNRNWVLCKLYGSPDLISKITSRVNENMIH<br>DFHKQEDLIREYQIKGICSNKKEQQDLRTFQVLKNRVELRDI<br>VEYSEIINELYGQLIKWCYLRERDLMYFQLGFHYLCLNNASS<br>KEADYIKINVDDRNISGAILYQIAAMYINGLPVYYKKDDMY<br>VALKSGKKASDELNSNEQTSKKINYFLKYGNNILGDKKDQL<br>YLAGLELFENVAEHENIIIFRNEIDHFHYFYDRDRSMLDLYSE<br>VFDRFFTYDMKLRKNVVNMLYNILLDHNIVSSFVFETGEKK<br>VGRGDSEVIKPSAKIRLRANNGVSSDVFTYKVGSKDELKIAT<br>LPAKNEEFLLNVARLIYYPDMEAVSENMVREGVVKVEKSND<br>KKGKISRGSNTRSSNQSKYNNKSKNRMNYSMGSIFEKMDLK<br>FD |
| c2c2-6 | 2 | Lachnospiraceae bacterium NK4A179 (SEQ ID No. 194) | MKISKVREENRGAKLTVNAKTAVVSENRSQEGILYNDPSRY<br>GKSRKNDEDRDRYIESRLKSSGKLYRIFNEDKNKRETDELQ<br>WFLSEIVKKINRRNGLVLSDMLSVDDRAFEKAFEKYAELSYT<br>NRRNKVSGSPAFETCGVDAATAERLKGIISETNFINRIKNNID<br>NKVSEDIIDRIIAKYLKKSLCRERVKRGLKKLLMNAFDLPYS<br>DPDIDVQRDFIDYVLEDFYHVRAKSQVSRSIKNMNMPVQPE<br>GDGKFAITVSKGGTESGNKRSAEKEAFKKFLSDYASLDERV |

TABLE 2-continued

| | | | |
|---|---|---|---|
| | | | RDDMLRRMRRLVVLYFYGSDDSKLSDVNEKFDVWEDHAA |
| | | | RRVDNREFIKLPLENKLANGKTDKDAERIRKNTVKELYRNQ |
| | | | NIGCYRQAVKAVEEDNNGRYFDDKMLNMFFIHRIEYGVEKI |
| | | | YANLKQVTEFKARTGYLSEKIWKDLINYISIKYIAMGKAVYN |
| | | | YAMDELNASDKKEIELGKISEEYLSGISSFDYELIKAEEMLQR |
| | | | ETAVYVAFAARHLSSQTVELDSENSDFLLLKPKGTMDKNDK |
| | | | NKLASNNILNFLKDKETLRDTILQYFGGHSLWTDFPFDKYLA |
| | | | GGKDDVDFLTDLKDVIYSMRNDSFHYATENHNNGKWNKEL |
| | | | ISAMFEHETERMTVVMKDKFYSNNLPMFYKNDDLKKLLIDL |
| | | | YKDNVERASQVPSFNKVFVRKNFPALVRDKDNLGIELDLKA |
| | | | DADKGENELKFYNALYYMFKEIYYNAFLNDKNVRERFITKA |
| | | | TKVADNYDRNKERNLKDRIKSAGSDEKKKLREQLQNYIAEN |
| | | | DFGQRIKNIVQVNPDYTLAQICQLIMTEYNQQNNGCMQKKS |
| | | | AARKDINKDSYQHYKMLLLVNLRKAFLEFIKENYAFVLKPY |
| | | | KHDLCDKADFVPDFAKYVKPYAGLISRVAGSSELQKWYIVS |
| | | | RFLSPAQANHMLGFLHSYKQYVWDIYRRASETGTEINHSIAE |
| | | | DKIAGVDITDVDAVIDLSVKLCGTISSEISDYFKDDEVYAEYI |
| | | | SSYLDFEYDGGNYKDSLNRFCNSDAVNDQKVALYYDGEHP |
| | | | KLNRNIILSKLYGERRFLEKITDRVSRSDIVEYYKLKKETSQY |
| | | | QTKGIFDSEDEQKNIKKFQEMKNIVEFRDLMDYSEIADELQG |
| | | | QLINWIYLRERDLMNFQLGYHYACLNNDSNKQATYVTLDY |
| | | | QGKKNRKINGAILYQICAMYINGLPLYYVDKDSSEWTVSDG |
| | | | KESTGAKIGEFYRYAKSFENTSDCYASGLEIFENISEHDNITEL |
| | | | RNYIEHFRYYSSFDRSFLGIYSEVFDRFFTYDLKYRKNVPTIL |
| | | | YNILLQHFVNVRFEFVSGKKMIGIDKKDRKIAKEKECARITIR |
| | | | EKNGVYSEQFTYKLKNGTVYVDARDKRYLQSIIRLLFYPEK |
| | | | VNMDEMIEVKEKKKPSDNNTGKGYSKRDRQQDRKEYDKY |
| | | | KEKKKKEGNFLSGMGGNINWDEINAQLKN |
| c2c2-7 | 3 | [*Clostridium*] | MKFSKVDHTRSAVGIQKATDSVHGMLYTDPKKQEVNDLDK |
| | | *aminophilum* | RFDQLNVKAKRLYNVFNQSKAEEDDDEKRFGKVVKKLNRE |
| | | DSM 10710 | LKDLLFHREVSRYNSIGNAKYNYYGIKSNPEEIVSNLGMVES |
| | | SEQ ID | LKGERDPQKVISKLLLYYLRKGLKPGTDGLRMILEASCGLRK |
| | | No. 195) | LSGDEKELKVFLQTLDEDFEKKTFKKNLIRSIENQNMAVQPS |
| | | | NEGDPIIGITQGRFNSQKNEEKSAIERMMSMYADLNEDHRED |
| | | | VLRKLRRLNVLYFNVDTEKTEEPTLPGEVDTNPVFEVWHDH |
| | | | EKGKENDRQFATFAKILTEDRETRKKEKLAVKEALNDLKSAI |
| | | | RDHNIMAYRCSIKVTEQDKDGLFFEDQRINRFWIHHIESAVE |
| | | | RILASINPEKLYKLRIGYLGEKVWKDLLNYLSIKYIAVGKAV |
| | | | FHFAMEDLGKTGQDIELGKLSNSVSGGLTSFDYEQIRADETL |
| | | | QRQLSVEVAFAANNLFRAVVGQTGKKIEQSKSEENEEDFLL |
| | | | WKAEKIAESIKKEGEGNTLKSILQFFGGASSWDLNHFCAAYG |
| | | | NESSALGYETKFADDLRKAIYSLRNETFHFTTLNKGSFDWNA |
| | | | KLIGDMFSHEAATGIAVERTRFYSNNLPMFYRESDLKRIMDH |
| | | | LYNTYHPRASQVPSFNSVFVRKNFRLFLSNTLNTNTSFDTEV |
| | | | YQKWESGVYYLFKEIYYNSFLPSGDAHHLFFEGLRRIRKEAD |
| | | | NLPIVGKEAKKRNAVQDFGRRCDELKNLSLSAICQMIMTEY |
| | | | NEQNNGNRKVKSTREDKRKPDIFQHYKMLLLRTLQEAFAIYI |
| | | | RREEFKFIFDLPKTLYVMKPVEEFLPNWKSGMFDSLVERVK |
| | | | QSPDLQRWYVLCKFLNGRLLNQLSGVIRSYIQFAGDIQRRAK |
| | | | ANHNRLYMDNTQRVEYYSNVLEVVDFCIKGTSRFSNVFSDY |
| | | | FRDEDAYADYLDNYLQFKDEKIAEVSSFAALKTFCNEEEVK |
| | | | AGIYMDGENPVMQRNIVMAKLFGPDEVLKNVVPKVTREEIE |
| | | | EYYQLEKQIAPYRQNGYCKSEEDQKKLLRFQRIKNRVEFQTI |
| | | | TEFSEIINELLGQLISWSFLRERDLLYFQLGFHYLCLHNDTEK |
| | | | PAEYKEISREDGTVIRNAILHQVAAMYVGGLPVYTLADKKL |
| | | | AAFEKGEADCKLSISKDTAGAGKKIKDFFRYSKYVLIKDRML |
| | | | TDQNQKYTIYLAGLELFENTDEHDNITDVRKYVDHFKYYAT |
| | | | SDENAMSILDLYSEIHDRFFTYDMKYQKNVANMLENILLRH |
| | | | FVLIRPEFFTGSKKVGEGKKITCKARAQIEIAENGMRSEDFTY |
| | | | KLSDGKKNISTCMIAARDQKYLNTVARLLYYPHEAKKSIVD |
| | | | TREKKNNKKTNRGDGTFNKQKGTARKEKDNGPREFNDTGF |
| | | | SNTPFAGFDPFRNS |
| c2c2-8 | 5 | *Carnobacterium* | MRITKVKIKLDNKLYQVTMQKEEKYGTLKLNEESRKSTAEIL |
| | | *gallinarum* | RLKKASFNKSFHSKTINSQKENKNATIKKNGDYISQIFEKLVG |
| | | DSM 4847 | VDTNKNIRKPKMSLTDLKDLPKKDLALFIKRKFKNDDIVEIK |
| | | (SEQ ID | NLDLISLFYNALQKVPGEHFTDESWADFCQEMMPYREYKNK |
| | | No. 196) | FIERKIILLANSIEQNKGFSINPETFSKRKRVLHQWAIEVQERG |
| | | | DFSILDEKLSKLAEIYNFKKMCKRVQDELNDLEKSMKKGKN |
| | | | PEKEKEAYKKQKNFKIKTIWKDYPYKTHIGLIEKIKENEELN |
| | | | QFNIEIGKYFEHYFPIKKERCTEDEPYYLNSETIATTVNYQLK |
| | | | NALISYLMQIGKYKQFGLENQVLDSKKLQEIGIYEGFQTKFM |
| | | | DACVFATSSLKNIIEPMRSGDILGKREFKEAIATSSFVNYHHF |
| | | | FPYFPFELKGMKDRESELIPFGEQTEAKQMQNIWALRGSVQQ |
| | | | IRNEIFHSFDKNQKFNLPQLDKSNFEFDASENSTGKSQSYIET |
| | | | DYKFLFEAEKNQLEQFFIERIKSSGALEYYPLKSLEKLFAKKE |
| | | | MKFSLGSQVVAFAPSYKKLVKKGHSYQTATEGTANYLGLS |
| | | | YYNRYELKEESFQAQYYLLKLIYQYVFLPNFSQGNSPAFRET |
| | | | VKAILRINKDEARKKMKKNKKFLRKYAFEQVREMEFKETPD |

TABLE 2-continued

| | | | |
|---|---|---|---|
| | | | QYMSYLQSEMREEKVRKAEKNDKGFEKNITMNFEKLLMQIF<br>VKGFDVFLTTFAGKELLLSSEEKVIKETEISLSKKINEREKTLK<br>ASIQVEHQLVATNSAISYWLFCKLLDSRHLNELRNEMIKFKQ<br>SRIKFNHTQHAELIQNLLPIVELTILSNDYDEKNDSQNVDVSA<br>YFEDKSLYETAPYVQTDDRTRVSFRPILKLEKYHTKSLIEALL<br>KDNPQFRVAATDIQEWMHKREEIGELVEKRKNLHTEWAEG<br>QQTLGAEKREEYRDYCKKIDRFNWKANKVTLTYLSQLHYLI<br>TDLLGRMVGFSALFERDLVYFSRSFSELGGETYHISDYKNLS<br>GVLRLNAEVKPIKIKNIKVIDNEENPYKGNEPEVKPFLDRLH<br>AYLENVIGIKAVHGKIRNQTAHLSVLQLELSMIESMNNLRDL<br>MAYDRKLKNAVTKSMIKILDKHGMILKLKIDENHKNFEIESL<br>IPKEIIHLKDKAIKTNQVSEEYCQLVLALLTTNPGNQLN |
| c2c2-9 | 6 | *Carnobacterium gallinarum* DSM 4847 (SEQ ID No. 197) | MRMTKVKINGSPVSMNRSKLNGHLVWNGTTNTVNILTKKE<br>QSFAASFLNKTLVKADQVKGYKVLAENIFIIFEQLEKSNSEKP<br>SVYLNNIRRLKEAGLKRFFKSKYHEEIKYTSEKNQSVPTKLN<br>LIPLFFNAVDRIQEDKFDEKNWSYFCKEMSPYLDYKKSYLNR<br>KKEILANSIQQNRGFSMPTAEEPNLLSKRKQLFQQWAMKFQ<br>ESPLIQQNNFAVEQFNKEFANKINELAAVYNVDELCTAITEK<br>LMNFDKDKSNKTRNFEIKKLWKQHPHNKDKALIKLFNQEG<br>NEALNQFNIELGKYFEHYFPKTGKKESAESYYLNPQTIIKTVG<br>YQLRNAFVQYLLQVGKLHQYNKGVLDSQTLQEIGMYEGFQ<br>TKFMDACVFASSSLRNIIQATTNEDILTREKFKKELEKNVELK<br>HDLFFKTEIVEERDENPAKKIAMTPNELDLWAIRGAVQRVR<br>NQIFHQQINKRHEPNQLKVGSFENGDLGNVSYQKTIYQKLFD<br>AEIKDIEIYFAEKIKSSGALEQYSMKDLEKLFSNKELTLSLGG<br>QVVAFAPSYKKLYKQGYFYQNEKTIELEQFTDYDFSNDVFK<br>ANYYLIKLIYHYVFLPQFSQANNKLFKDTVHYVIQQNKELNT<br>TEKDKKNNKKIRKYAFEQVKLMKNESPEKYMQYLQREMQE<br>ERTIKEAKKTNEEKPNYNFEKLLIQIFIKGFDTFLRNFDLNLNP<br>AEELVGTVKEKAEGLRKRKERIAKILNVDEQIKTGDEEIAFW<br>IFAKLLDARHLSELRNEMIKFKQSSVKKGLIKNGDLIEQMQPI<br>LELCILSNDSESMEKESFDKIEVFLEKVELAKNEPYMQEDKL<br>TPVKFRFMKQLEKYQTRNFIENLVIENPEFKVSEKIVLNWHE<br>EKEKIADLVDKRTKLHEEWASKAREIEEYNEKIKKNKSKKL<br>DKPAEFAKFAEYKIICEAIENFNRLDHKVRLTYLKNLHYLMI<br>DLMGRMVGFSVLFERDFVYMGRSYSALKKQSIYLNDYDTF<br>ANIRDWEVNENKHLFGTSSSDLTFQETAEFKNLKKPMENQL<br>KALLGVTNHSFEIRNNIAHLHVLRNDGKGEGVSLLSCMNDL<br>RKLMSYDRKLKNAVTKAIIKILDKHGMILKLTNNDHTKPFEI<br>ESLKPKKIIHLEKSNHSFPMDQVSQEYCDLVKKMLVFTN |
| c2c2-10 | 7 | *Paludibacter propionicigenes* WB4 (SEQ ID No. 198) | MRVSKVKVKDGGKDKMVLVHRKTTGAQLVYSGQPVSNET<br>SNILPEKKRQSFDLSTLNKTIIKFDTAKKQKLNVDQYKIVEKI<br>FKYPKQELPKQIKAEEILPFLNHKFQEPVKWKNGKEESFNL<br>TLLIVEAVQAQDKRKLQPYYDWKTWYIQTKSDLLKKSIENN<br>RIDLTENLSKRKKALLAWETEFTASGSIDLTHYHKVYMTDV<br>LCKMLQDVKPLTDDKGKINTNAYHRGLKKALQNHQPAIFGT<br>REVPNEANRADNQLSIYHLEVVKYLEHYFPIKTSKRRNTADD<br>IAHYLKAQTLKTTIEKQLVNAIRANIIQQGKTNHHELKADTT<br>SNDLIRIKTNEAFVLNLTGTCAFAANNIRNMVDNEQTNDILG<br>KGDFIKSLLKDNTNSQLYSFFFGEGLSTNKAEKETQLWGIRG<br>AVQQIRNNVNHYKKDALKTVFNISNFENPTITDPKQQTNYA<br>DTIYKARFINELEKIPEAFAQQLKTGGAVSYYTIENLKSLLTT<br>FQFSLCRSTIPFAPGFKKVFNGGINYQNAKQDESFYELMLEQ<br>YLRKENFAEESYNARYFMLKLIYNNLFLPGFTTDRKAFADSV<br>GFVQMQNKKQAEKVNPRKKEAYAFEAVRPMTAADSIADY<br>MAYVQSELMQEQNKKEEKVAEETRINFEKFVLQVFIKGFDS<br>FLRAKEFDFVQMPQPQLTATASNQQKADKLNQLEASITADC<br>KLTPQYAKADDATHIAFYVFCKLLDAAHLSNLRNELIKFRES<br>VNEFKFHHLLEIIEICLLSADVVPTDYRDLYSSEADCLARLRP<br>FIEQGADITNWSDLFVQSDKHSPVIHANIELSVKYGTTKLLEQ<br>IINKDTQFKTTEANFTAWNTAQKSIEQLIKQREDHHEQWVK<br>AKNADDKEKQERKREKSNFAQKFIEKHGDDYLDICDYINTY<br>NWLDNKMHFVHLNRLHGLTIELLGRMAGFVALFDRDFQFF<br>DEQQIADEFKLHGFVNLHSIDKKLNEVPTKKIKEIYDIRNKIIQ<br>INGNKINESVRANLIQFISSKRNYYNNAFLHVSNDEIKEKQM<br>YDIRNHIAHFNYLTKDAADFSLIDLINELRELLHYDRKLKNA<br>VSKAFIDLFDKHGMILKLKLNADHKLKVESLEPKKIYHLGSS<br>AKDKPEYQYCTNQVMMAYCNMCRSLLEMKK |
| c2c2-11 | 9 | *Listeria weihenstephanensis* FSL R9-0317 (SEQ ID No. 199) | MLALLHQEVPSQKLHNLKSLNTESLTKLFKPKFQNMISYPPS<br>KGAEHVQFCLTDIAVPAIRDLDEIKPDWGIFFEKLKPYTDWA<br>ESYIHYKQTTIQKSIEQNKIQSPDSPRKLVLQKYVTAFLNGEP<br>LGLDLVAKKYKLADLAESFKVVDLNEDKSANYKIKACLQQ<br>HQRNILDELKEDPELNQYGIEVKKYIQRYFPIKRAPNRSKHA<br>RADFLKKELIESTVEQQFKNAVYHYVLEQGKMEAYELTDPK<br>TKDLQDIRSGEAFSFKFINACAFASNNLKMILNPECEKDILGK<br>GDFKKNLPNSTTQSDVVKKMIPFFSDEIQNVNFDEAIWAIRG<br>SIQQIRNEVYHCKKHSWKSILKIKGFEFEPNNMKYTDSDMQK |

TABLE 2-continued

| | | | |
|---|---|---|---|
| | | | LMDKDIAKIPDFIEEKLKSSGIIRFYSHDKLQSIWEMKQGFSL<br>LTTNAPFVPSFKRVYAKGHDYQTSKNRYYDLGLTTFDILEY<br>GEEDFRARYFLTKLVYYQQFMPWFTADNNAFRDAANFVLR<br>LNKNRQQDAKAFINIREVEEGEMPRDYMGYVQGQIAIHEDS<br>TEDTPNHFEKFISQVFIKGFDSHMRSADLKFIKNPRNQGLEQS<br>EIEEMSFDIKVEPSFLKNKDDYIAFWTFCKMLDARHLSELRN<br>EMIKYDGHLTGEQEIIGLALLGVDSRENDWKQFFSSEREYEK<br>IMKGYVGEELYQREPYRQSDGKTPILFRGVEQARKYGTETVI<br>QRLFDASPEFKVSKCNITEWERQKETIEETIERRKELHNEWE<br>KNPKKPQNNAFFKEYKECCDAIDAYNWHKNKTTLVYVNEL<br>HHLLIEILGRYVGYVAIADRDFQCMANQYFKHSGITERVEY<br>WGDNRLKSIKKLDTFLKKEGLFVSEKNARNHIAHLNYLSLK<br>SECTLLYLSERLREIFKYDRKLKNAVSKSLIDILDRHGMSVVF<br>ANLKENKHRLVIKSLEPKKLRHLGEKKIDNGYIETNQVSEEY<br>CGIVKRLLEI |
| c2c2-12 | 10 | Listeriaceae bacterium FSL M6-0635 = *Listeria newyorkensis* FSL M6-0635 (SEQ ID No. 200) | MKITKMRVDGRTIVMERTSKEGQLGYEGIDGNKTTEIIFDKK<br>KESFYKSILNKTVRKPDEKEKNRRKQAINKAINKEITELMLA<br>VLHQEVPSQKLHNLKSLNTESLTKLFKPKFQNMISYPPSKGA<br>EHVQFCLTDIAVPAIRDLDEIKPDWGIFFEKLKPYTDWAESYI<br>HYKQTTIQKSIEQNKIQSPDSPRKLVLQKYVTAFLNGEPLGL<br>DLVAKKYKLADLAESFKLVDLNEDKSANYKIKACLQQHQR<br>NILDELKEDPELNQYGIEVKKYIQRYFPIKRAPNRSKHARADF<br>LKKELIESTVEQQFKNAVYHYVLEQGKMEAYELTDPKTKDL<br>QDIRSGEAFSFKFINACAFASNNLKMILNPECEKDILGKGNFK<br>KNLPNSTTRSDVVKKMIPFFSDELQNVNFDEAIWAIRGSIQQI<br>RNEVYHCKKHSWKSILKIKGFEFEPNNMKYADSDMQKLMD<br>KDIAKIPEFIEEKLKSSGVVRFYRHDELQSIWEMKQGFSLLTT<br>NAPFVPSFKRVYAKGHDYQTSKNRYYNLDLTTFDILEYGEE<br>DFRARYFLTKLVYYQQFMPWFTADNNAFRDAANFVLRLNK<br>NRQQDAKAFINIREVEEGEMPRDYMGYVQGQIAIHEDSIEDT<br>PNHFEKFISQVFIKGFDRHMRSANLKFIKNPRNQGLEQSEIEE<br>MSFDIKVEPSFLKNKDDYIAFWIFCKMLDARHLSELRNEMIK<br>YDGHLTGEQEIIGLALLGVDSRENDWKQFFSSEREYEKIMKG<br>YVVEELYQREPYRQSDGKTPILFRGVEQARKYGTETVIQRLF<br>DANPEFKVSKCNLAEWERQKETIEETIKRRKELHNEWAKNP<br>KKPQNNAFFKEYKECCDAIDAYNWHKNKTTLAYVNELHHL<br>LIEILGRYVGYVAIADRDFQCMANQYFKHSGITERVEYWGD<br>NRLKSIKKLDTFLKKEGLFVSEKNARNHIAHLNYLSLKSECT<br>LLYLSERLREIFKYDRKLKNAVSKSLIDILDRHGMSVVFANL<br>KENKHRLVIKSLEPKKLRHLGGKKIDGGYIETNQVSEEYCGI<br>VKRLLEM |
| c2c2-13 | 12 | *Leptotrichia wadei* F0279 (SEQ ID No. 201) | MKVTKVDGISHKKYIEEGKLVKSTSEENRTSERLSELLSIRLD<br>IYIKNPDNASEEENRIRRENLKKFFSNKVLHLKDSVLYLKNR<br>KEKNAVQDKNYSEEDISEYDLKNKNSFSVLKKILLNEDVNSE<br>ELEIFRKDVEAKLNKINSLKYSFEENKANYQKINENNVEKVG<br>GKSKRNIIYDYYRESAKRNDYINNVQEAFDKLYKKEDIEKLF<br>FLIENSKKHEKYKIREYYHKIIGRKNDKENFAKIIYEEIQNVN<br>NIKELIEKIPDMSELKKSQVFYKYYLDKEELNDKNIKYAFCH<br>FVEIEMSQLLKNYVYKRLSNISNDKIKRIFEYQNLKKLIENKL<br>LNKLDTYVRNCGKYNYYLQVGEIATSDFIARNRQNEAFLRNI<br>IGVSSVAYFSLRNILETENENDITGRMRGKTVKNNKGEEKYV<br>SGEVDKIYNENKQNEVKENLKMFYSYDFNMDNKNEIEDFFA<br>NIDEAISSIRHGIVHFNLELEGKDIFAFKNIAPSEISKKMFQNEI<br>NEKKLKLKIFKQLNSANVFNYYEKDVIIKYLKNTKFNFVNK<br>NIPFVPSFTKLYNKIEDLRNTLKFFWSVPKDKEEKDAQIYLLK<br>NIYYGEFLNKFVKNSKVFFKITNEVIKINKQRNQKTGHYKYQ<br>KFENIEKTVPVEYLAIIQSREMINNQDKEEKNTYIDFIQQIFLK<br>GFIDYLNKNNLKYIESNNNNDNNDIFSKIKIKKDNKEKYDKIL<br>KNYEKHNRNKEIPHEINEFVREIKLGKILKYTENLNMFYLILK<br>LLNHKELTNLKGSLEKYQSANKEETFSDELELINLLNLDNNR<br>VTEDFELEANEIGKFLDFNENKIKDRKELKKFDTNKIYFDGE<br>NIIKHRAFYNIKKYGMLNLLEKIADKAKYKISLKELKEYSNK<br>KNEIEKNYTMQQNLHRKYARPKKDEKFNDEDYKEYEKAIG<br>NIQKYTHLKNKVEFNELNLLQGLLLKILHRLVGYTSIWERDL<br>RFRLKGEFPENHYIEEIFNFDNSKNVKYKSGQIVEKYINFYKE<br>LYKDNVEKRSIYSDKKVKKLKQEKKDLYIRNYIAHFNYIPHA<br>EISLLEVLENLRKLLSYDRKLKNAIMKSIVDILKEYGFVATFK<br>IGADKKIEIQTLESEKIVHLKNLKKKKLMTDRNSEELCELVK<br>VMFEYKALE |
| c2c2-14 | 15 | *Rhodobacter capsulatus* SB 1003 (SEQ ID No. 202) | MQIGKVQGRTISEFGDPAGGLKRKISTDGKNRKELPAHLSSD<br>PKALIGQWISGIDKIYRKPDSRKSDGKAIHSPTPSKMQFDARD<br>DLGEAFWKLVSEAGLAQDSDYDQFKRRLHPYGDKFQPADS<br>GAKLKFEADPPEPQAFHGRWYGAMSKRGNDAKELAAALYE<br>HLHVDEKRIDGQPKRNPKTDKFAPGLVVARALGIESSVLPRG<br>MARLARNWGEEEIQTYFVVDVAASVKEVAKAAVSAAQAFD<br>PPRQVSGRSLSPKVGFALAEHLERVTGSKRCSFDPAAGPSVL<br>ALHDEVKKTYKRLCARGKNAARAFPADKTELLALMRHTHE |

TABLE 2-continued

| | | | |
|---|---|---|---|
| | | | NRVRNQMVRMGRVSEYRGQQAGDLAQSHYWTSAGQTEIK<br>ESEIFVRLWVGAFALAGRSMKAWIDPMGKIVNTEKNDRDLT<br>AAVNIRQVISNKEMVAEAMARRGIYFGETPELDRLGAEGNE<br>GFVFALLRYLRGCRNQTFHLGARAGFLKEIRKELEKTRWGK<br>AKEAEHVVLTDKTVAAIRAIIDNDAKALGARLLADLSGAFV<br>AHYASKEHFSTLYSEIVKAVKDAPEVSSGLPRLKLLLKRADG<br>VRGYVHGLRDTRKHAFATKLPPPPAPRELDDPATKARYIALL<br>RLYDGPFRAYASGITGTALAGPAARAKEAATALAQSVNVTK<br>AYSDVMEGRTSRLRPPNDGETLREYLSALTGETATEFRVQIG<br>YESDSENARKQAEFIENYRRDMLAFMFEDYIRAKGFDWILKI<br>EPGATAMTRAPVLPEPIDTRGQYEHWQAALYLVMHFVPASD<br>VSNLLHQLRKWEALQGKYELVQDGDATDQADARREALDL<br>VKRFRDVLVLFLKTGEARFEGRAAPFDLKPFRALFANPATFD<br>RLFMATPTTARPAEDDPEGDGASEPELRVARTLRGLRQIARY<br>NHMAVLSDLFAKHKVRDEEVARLAEIEDETQEKSQIVAAQE<br>LRTDLHDKVMKCHPKTISPEERQSYAAAIKTIEEHRFLVGRV<br>YLGDHLRLHRLMMDVIGRLIDYAGAYERDTGTFLINASKQL<br>GAGADWAVTIAGAANTDARTQTRKDLAHFNVLDRADGTPD<br>LTALVNRAREMMAYDRKRKNAVPRSILDMLARLGLTLKWQ<br>MKDHLLQDATITQAAIKHLDKVRLTVGGPAAVTEARFSQDY<br>LQMVAAVFNGSVQNPKPRRRDDGDAWHKPPKPATAQSQPD<br>QKPPNKAPSAGSRLPPPQVGEVYEGVVVKVIDTGSLGFLAVE<br>GVAGNIGLHISRLRRIREDAIIVGRRYRFRVEIYVPPKSNTSKL<br>NAADLVRID |
| c2c2-15 | 16 | *Rhodobacter capsulatus* R121 (SEQ ID No. 203) | MQIGKVQGRTISEFGDPAGGLKRKISTDGKNRKELPAHLSSD<br>PKALIGQWISGIDKIYRKPDSRKSDGKAIHSPTPSKMQFDARD<br>DLGEAFWKLVSEAGLAQDSDYDQFKRRLHPYGDKFQPADS<br>GAKLKFEADPPEPQAFHGRWYGAMSKRGNDAKELAAALYE<br>HLHVDEKRIDGQPKRNPKTDKFAPGLVVARALGIESSVLPRG<br>MARLARNWGEEEIQTYFVVDVAASVKEVAKAAVSAAQAFD<br>PPRQVSGRSLSPKVGFALAEHLERVTGSKRCSFDPAAGPSVL<br>ALHDEVKKTYKRLCARGKNAARAFPADKTELLALMRHTHE<br>NRVRNQMVRMGRVSEYRGQQAGDLAQSHYWTSAGQTEIK<br>ESEIFVRLWVGAFALAGRSMKAWIDPMGKIVNTEKNDRDLT<br>AAVNIRQVISNKEMVAEAMARRGIYFGETPELDRLGAEGNE<br>GFVFALLRYLRGCRNQTFHLGARAGFLKEIRKELEKTRWGK<br>AKEAEHVVLTDKTVAAIRAIIDNDAKALGARLLADLSGAFV<br>AHYASKEHFSTLYSEIVKAVKDAPEVSSGLPRLKLLLKRADG<br>VRGYVHGLRDTRKHAFATKLPPPPAPRELDDPATKARYIALL<br>RLYDGPFRAYASGITGTALAGPAARAKEAATALAQSVNVTK<br>AYSDVMEGRSSRLRPPNDGETLREYLSALTGETATEFRVQIG<br>YESDSENARKQAEFIENYRRDMLAFMFEDYIRAKGFDWILKI<br>EPGATAMTRAPVLPEPIDTRGQYEHWQAALYLVMHFVPASD<br>VSNLLHQLRKWEALQGKYELVQDGDATDQADARREALDL<br>VKRFRDVLVLFLKTGEARFEGRAAPFDLKPFRALFANPATFD<br>RLFMATPTTARPAEDDPEGDGASEPELRVARTLRGLRQIARY<br>NHMAVLSDLFAKHKVRDEEVARLAEIEDETQEKSQIVAAQE<br>LRTDLHDKVMKCHPKTISPEERQSYAAAIKTIEEHRFLVGRV<br>YLGDHLRLHRLMMDVIGRLIDYAGAYERDTGTFLINASKQL<br>GAGADWAVTIAGAANTDARTQTRKDLAHFNVLDRADGTPD<br>LTALVNRAREMMAYDRKRKNAVPRSILDMLARLGLTLKWQ<br>MKDHLLQDATITQAAIKHLDKVRLTVGGPAAVTEARFSQDY<br>LQMVAAVFNGSVQNPKPRRRDDGDAWHKPPKPATAQSQPD<br>QKPPNKAPSAGSRLPPPQVGEVYEGVVVKVIDTGSLGFLAVE<br>GVAGNIGLHISRLRRIREDAIIVGRRYRFRVEIYVPPKSNTSKL<br>NAADLVRID |
| c2c2-16 | 17 | *Rhodobacter capsulatus* DE442 (SEQ ID No. 204) | MQIGKVQGRTISEFGDPAGGLKRKISTDGKNRKELPAHLSSD<br>PKALIGQWISGIDKIYRKPDSRKSDGKAIHSPTPSKMQFDARD<br>DLGEAFWKLVSEAGLAQDSDYDQFKRRLHPYGDKFQPADS<br>GAKLKFEADPPEPQAFHGRWYGAMSKRGNDAKELAAALYE<br>HLHVDEKRIDGQPKRNPKTDKFAPGLVVARALGIESSVLPRG<br>MARLARNWGEEEIQTYFVVDVAASVKEVAKAAVSAAQAFD<br>PPRQVSGRSLSPKVGFALAEHLERVTGSKRCSFDPAAGPSVL<br>ALHDEVKKTYKRLCARGKNAARAFPADKTELLALMRHTHE<br>NRVRNQMVRMGRVSEYRGQQAGDLAQSHYWTSAGQTEIK<br>ESEIFVRLWVGAFALAGRSMKAWIDPMGKIVNTEKNDRDLT<br>AAVNIRQVISNKEMVAEAMARRGIYFGETPELDRLGAEGNE<br>GFVFALLRYLRGCRNQTFHLGARAGFLKEIRKELEKTRWGK<br>AKEAEHVVLTDKTVAAIRAIIDNDAKALGARLLADLSGAFV<br>AHYASKEHFSTLYSEIVKAVKDAPEVSSGLPRLKLLLKRADG<br>VRGYVHGLRDTRKHAFATKLPPPPAPRELDDPATKARYIALL<br>RLYDGPFRAYASGITGTALAGPAARAKEAATALAQSVNVTK<br>AYSDVMEGRSSRLRPPNDGETLREYLSALTGETATEFRVQIG<br>YESDSENARKQAEFIENYRRDMLAFMFEDYIRAKGFDWILKI<br>EPGATAMTRAPVLPEPIDTRGQYEHWQAALYLVMHFVPASD<br>VSNLLHQLRKWEALQGKYELVQDGDATDQADARREALDL<br>VKRFRDVLVLFLKTGEARFEGRAAPFDLKPFRALFANPATFD<br>RLFMATPTTARPAEDDPEGDGASEPELRVARTLRGLRQIARY |

TABLE 2-continued

| | | |
|---|---|---|
| | | NHMAVLSDLFAKHKVRDEEVARLAEIEDETQEKSQIVAAQE<br>LRTDLHDKVMKCHPKTISPEERQSYAAAIKTIEEHRFLVGRV<br>YLGDHLRLHRLMMDVIGRLIDYAGAYERDTGTFLINASKQL<br>GAGADWAVTIAGAANTDARTQTRKDLAHFNVLDRADGTPD<br>LTALVNRAREMMAYDRKRKNAVPRSILDMLARLGLTLKWQ<br>MKDHLLQDATITQAAIKHLDKVRLTVGGPAAVTEARFSQDY<br>LQMVAAVFNGSVQNPKPRRRDDGDAWHKPPKPATAQSQPD<br>QKPPNKAPSAGSRLPPPQVGEVYEGVVVKVIDTGSLGFLAVE<br>GVAGNIGLHISRLRRIREDAIIVGRRYRFRVEIYVPPKSNTSKL<br>NAADLVRID |
| c2c2-2 | (SEQ ID No. 205) | MGNLFGHKRWYEVRDKKDFKIKRKVKVKRNYDGNKYILNI<br>NENNNKEKIDNNKFIRKYINYKKNDNILKEFTRKFHAGNILF<br>KLKGKEGIIRIENNDDFLETEEVVLYIEAYGKSEKLKALGITK<br>KKIIDEAIRQGITKDDKKIEIKRQENEEEIEIDIRDEYTNKTLND<br>CSIILRIIENDELETKKSIYEIFKNINMSLYKIIEKIIENETEKVFE<br>NRYYEEHLREKLLKDDKIDVILTNFMEIREKIKSNLEILGFVK<br>FYLNVGGDKKKSKNKKMLVEKILNINVDLTVEDIADFVIKEL<br>EFWNITKRIEKVKKVNNEFLEKRRNRTYIKSYVLLDKHEKFK<br>IERENKKDKIVKFFVENIKNNSIKEKIEKILAEFKIDELIKKLEK<br>ELKKGNCDTEIFGIFKKHYKVNFDSKKFSKKSDEEKELYKIIY<br>RYLKGRIEKILVNEQKVRLKKMEKIEIEKILNESILSEKILKRV<br>KQYTLEHIMYLGKLRHNDIDMTTVNTDDFSRLHAKEELDLE<br>LITFFASTNMELNKIFSRENINNDENIDFFGGDREKNYVLDKK<br>ILNSKIKIIRDLDFIDNKNNITNNFIRKFTKIGTNERNRILHAISK<br>ERDLQGTQDDYNKVINIIQNLKISDEEVSKALNLDVVFKDKK<br>NIITKINDIKISEENNNDIKYLPSFSKVLPEILNLYRNNPKNEPF<br>DTIETEKIVLNALIYVNKELYKKLILEDDLEENESKNIFLQELK<br>KTLGNIDEIDENIIENYYKNAQISASKGNNKAIKKYQKKVIEC<br>YIGYLRKNYEELFDFSDFKMNIQEIKKQIKDINDNKTYERITV<br>KTSDKTIVINDDFEYIISIFALLNSNAVINKIRNRFFATSVWLN<br>TSEYQNIIDILDEIMQLNTLRNECITENWNLNLEEFIQKMKEIE<br>KDFDDFKIQTKKEIFNNYYEDIKNNILTEFKDDINGCDVLEKK<br>LEKIVIFDDETKFEIDKKSNILQDEQRKLSNINKKDLKKKVDQ<br>YIKDKDQEIKSKILCRIIFNSDFLKKYKKEIDNLIEDMESENEN<br>KFQEIYYPKERKNELYIYKKNLFLNIGNPNFDKIYGLISNDIK<br>MADAKFLFNIDGKNIRKNKISEIDAILKNLNDKLNGYSKEYK<br>EKYIKKLKENDDFFAKNIQNKNYKSFEKDYNRVSEYKKIRD<br>LVEFNYLNKIESYLIDINWKLAIQMARFERDMHYIVNGLREL<br>GIIKLSGYNTGISRAYPKRNGSDGFYTTTAYYKFFDEESYKKF<br>EKICYGFGIDLSENSEINKPENESIRNYISHFYIVRNPFADYSIA<br>EQIDRVSNLLSYSTRYNNSTYASVFEVFKKDVNLDYDELKK<br>KFKLIGNNDILERLMKPKKVSVLELESYNSDYIKNLIIELLTKI<br>ENTNDTL |
| c2c2-3 | *L wadei* (Lw2) (SEQ ID No. 206) | MKVTKVDGISHKKYIEEGKLVKSTSEENRTSERLSELLSIRLD<br>IYIKNPDNASEEENRIRRENLKKFFSNKVLHLKDSVLYLKNR<br>KEKNAVQDKNYSEEDISEYDLKNKNSFSVLKKILLNEDVNSE<br>ELEIFRKDVEAKLNKINSLKYSFEENKANYQKINENNVEKVG<br>GKSKRNIIYDYYRESAKRNDYINNVQEAFDKLYKKEDIEKLF<br>FLIENSKKHEKYKIREYYHKIIGRKNDKENFAKIIYEEIQNVN<br>NIKELIEKIPDMSELKKSQVFYKYYLDKEELNDKNIKYAFCH<br>FVEIEMSQLLKNYVYKRLSNISNDKIKRIFEYQNLKKLIENKL<br>LNKLDTYVRNCGKYNYYLQVGEIATSDFIARNRQNEAFLRNI<br>IGVSSVAYFSLRNILETENENDITGRMRGKTVKNNKGEEKYV<br>SGEVDKIYNENKQNEVKENLKMFYSYDFNMDNKNEIEDFFA<br>NIDEAISSIRHGIVHFNLELEGKDIFAFKNIAPSEISKKMFQNEI<br>NEKKLKLKIFKQLNSANVFNYYEKDVIIKYLKNTKFNFVNK<br>NIPFVPSFTKLYNKIEDLRNTLKFFWSVPKDKEEKDAQIYLLK<br>NIYYGEFLNKFVKNSKVFFKITNEVIKINKQRNQKTGHYKYQ<br>KFENIEKTVPVEYLAIIQSREMINNQDKEEKNTYIDFIQQIFLK<br>GFIDYLNKNNLKYIESNNNNDNNDIFSKIKIKKDNKEKYDKIL<br>KNYEKHNRNKEIPHEINEFVREIKLGKILKYTENLNMFYLILK<br>LLNHKELTNLKGSLEKYQSANKEETFSDELELINLLNLDNNR<br>VTEDFELEANEIGKFLDFNENKIKDRKELKKFDTNKIYFDGE<br>NIIKHRAFYNIKKYGMLNLLEKIADKAKYKISLKELKEYSNK<br>KNEIEKNYTMQQNLHRKYARPKKDEKFNDEDYKEYEKAIG<br>NIQKYTHLKNKVEFNELNLLQGLLLKILHRLVGYTSIWERDL<br>RFRLKGEFPENHYIEEIFNFDNSKNVKYKSGQIVEKYINFYKE<br>LYKDNVEKRSIYSDKKVKKLKQEKKDLYIRNYIAHFNYIPHA<br>EISLLEVLENLRKLLSYDRKLKNAIMKSIVDILKEYGFVATFK<br>IGADKKIEIQTLESEKIVHLKNLKKKKLMTDRNSEELCELVK<br>VMFEYKALEKRPAATKKAGQAKKKKGSYPYDVPDYAYPY<br>DVPDYAYPYDVPDYA* |
| c2c2-4 | *Listeria seeligeri* (SEQ ID No. 207) | MWISIKTLIHHLGVLFFCDYMYNRREKKIIEVKTMRITKVEV<br>DRKKVLISRDKNGGKLVYENEMQDNTEQIMHHKKSSFYKS<br>VVNKTICRPEQKQMKKLVHGLLQENSQEKIKVSDVTKLNIS<br>NFLNHRFKKSLYYFPENSPDKSEEYRIEINLSQLLEDSLKKQQ<br>GTFICWESFSKDMELYINWAENYISSKTKLIKKSIRNNRIQST |

TABLE 2-continued

| | | |
|---|---|---|
| | | ESRSGQLMDRYMKDILNKNKPFDIQSVSEKYQLEKLTSALK<br>ATFKEAKKNDKEINYKLKSTLQNHERQIIEELKENSELNQFNI<br>EIRKHLETYFPIKKTNRKVGDIRNLEIGEIQKIVNHRLKNKIVQ<br>RILQEGKLASYEIESTVNSNSLQKIKIEEAFALKFINACLFASN<br>NLRNMVYPVCKKDILMIGEFKNSFKEIKHKKFIRQWSQFFSQ<br>EITVDDIELASWGLRGAIAPIRNEIIHLKKHSWKKFFNNPTFK<br>VKKSKIINGKTKDVTSEFLYKETLFKDYFYSELDSVPELIINK<br>MESSKILDYYSSDQLNQVFTIPNFELSLLTSAVPFAPSFKRVY<br>LKGFDYQNQDEAQPDYNLKLNIYNEKAFNSEAFQAQYSLFK<br>MVYYQVFLPQFTTNNDLFKSSVDFILTLNKERKGYAKAFQDI<br>RKMNKDEKPSEYMSYIQSQLMLYQKKQEEKEKINHFEKFIN<br>QVFIKGFNSFIEKNRLTYICHPTKNTVPENDNIEIPFHTDMDDS<br>NIAFWLMCKLLDAKQLSELRNEMIKFSCSLQSTEEISTFTKAR<br>EVIGLALLNGEKGCNDWKELFDDKEAWKKNMSLYVSEELL<br>QSLPYTQEDGQTPVINRSIDLVKKYGTETILEKLFSSSDDYKV<br>SAKDIAKLHEYDVTEKIAQQESLHKQWIEKPGLARDSAWTK<br>KYQNVINDISNYQWAKTKVELTQVRHLHQLTIDLLSRLAGY<br>MSIADRDFQFSSNYILERENSEYRVTSWILLSENKNKNKYND<br>YELYNLKNASIKVSSKNDPQLKVDLKQLRLTLEYLELFDNRL<br>KEKRNNISHFNYLNGQLGNSILELFDDARDVLSYDRKLKNA<br>VSKSLKEILSSHGMEVTFKPLYQTNHHLKIDKLQPKKIHHLG<br>EKSTVSSNQVSNEYCQLVRTLLTMK |
| C2-17 | *Leptotrichia buccalis* C-1013-b (SEQ ID No. 208) | MKVTKVGGISHKKYTSEGRLVKSESEENRTDERLSALLNMR<br>LDMYIKNPSSTETKENQKRIGKLKKFFSNKMVYLKDNTLSL<br>KNGKKENIDREYSETDILESDVRDKKNFAVLKKIYLNENVNS<br>EELEVFRNDIKKKLNKINSLKYSFEKNKANYQKINENNIEKV<br>EGKSKRNIIYDYYRESAKRDAYVSNVKEAFDKLYKEEDIAK<br>LVLEIENLTKLEKYKIREFYHEIIGRKNDKENFAKIIYEEIQNV<br>NNMKELIEKVPDMSELKKSQVFYKYYLDKEELNDKNIKYAF<br>CHFVEIEMSQLLKNYVYKRLSNISNDKIKRIFEYQNLKKLIEN<br>KLLNKLDTYVRNCGKYNYYLQDGEIATSDFIARNRQNEAFL<br>RNIIGVSSVAYFSLRNILETENENDITGRMRGKTVKNNKGEE<br>KYVSGEVDKIYNENKKNEVKENLKMFYSYDFNMDNKNEIE<br>DFFANIDEAISSIRHGIVHFNLELEGKDIFAFKNIAPSEISKKMF<br>QNEINEKKLKLKIFRQLNSANVFRYLEKYKILNYLKRTRFEF<br>VNKNIPFVPSFTKLYSRIDDLKNSLGIYWKTPKTNDDNKTKEI<br>IDAQIYLLKNIYYGEFLNYFMSNNGNFFEISKEIIELNKNDKR<br>NLKTGFYKLQKFEDIQEKIPKEYLANIQSLYMINAGNQDEEE<br>KDTYIDFIQKIFLKGFMTYLANNGRLSLIYIGSDEETNTSLAE<br>KKQEFDKFLKKYEQNNNIKIPYEINEFLREIKLGNILKYTERL<br>NMFYLILKLLNHKELTNLKGSLEKYQSANKEEAFSDQLELIN<br>LLNLDNNRVTEDFELEADEIGKFLDFNGNKVKDNKELKKFD<br>TNKIYFDGENIIKHRAFYNIKKYGMLNLLEKIADKAGYKISIE<br>ELKKYSNKKNEIEKNHKMQENLHRKYARPRKDEKFTDEDY<br>ESYKQAIENIEEYTHLKNKVEFNELNLLQGLLLRILHRLVGY<br>TSIWERDLRFRLKGEFPENQYIEEIFNFENKKNVKYKGGQIVE<br>KYIKFYKELHQNDEVKINKYSSANIKVLKQEKKDLYIRNYIA<br>HFNYIPHAEISLLEVLENLRKLLSYDRKLKNAVMKSVVDILK<br>EYGFVATFKIGADKKIGIQTLESEKIVHLKNLKKKKLMTDRN<br>SEELCKLVKIMFEYKMEEKKSEN |
| C2-18 | *Herbinix hemicellulosilytica* (SEQ ID No. 209) | MKLTRRRISGNSVDQKITAAFYRDMSQGLLYYDSEDNDCTD<br>KVIESMDFERSWRGRILKNGEDDKNPFYMFVKGLVGSNDKI<br>VCEPIDVDSDPDNLDILINKNLTGFGRNLKAPDSNDTLENLIR<br>KIQAGIPEEEVLPELKKIKEMIQKDIVNRKEQLLKSIKNNRIPF<br>SLEGSKLVPSTKKMKWLFKLIDVPNKTFNEKMLEKYWEIYD<br>YDKLKANITNRLDKTDKKARSISRAVSEELREYHKNLRTNY<br>NRFVSGDRPAAGLDNGGSAKYNPDKEEFLLFLKEVEQYFKK<br>YFPVKSKHSNKSKDKSLVDKYKNYCSYKVVKKEVNRSIINQ<br>LVAGLIQQGKLLYYFYYNDTWQEDFLNSYGLSYIQVEEAFK<br>KSVMTSLSWGINRLTSFFIDDSNTVKFDDITTKKAKEAIESNY<br>FNKLRTCSRMQDHFKEKLAFFYPVYVKDKKDRPDDDIENLI<br>VLVKNAIESVSYLRNRTFHFKESSLLELLKELDDKNSGQNKI<br>DYSVAAEFIKRDIENLYDVFREQIRSLGIAEYYKADMISDCFK<br>TCGLEFALYSPKNSLMPAFKNVYKRGANLNKAYIRDKGPKE<br>TGDQGQNSYKALEEYRELTWYIEVKNNDQSYNAYKNLLQLI<br>YYHAFLPEVRENEALITDFINRTKEWNRKETEERLNTKNNKK<br>HKNFDENDDITVNTYRYESIPDYQGESLDDYLKVLQRKQMA<br>RAKEVNEKEEGNNNYIQFIRDVVVWAFGAYLENKLKNYKN<br>ELQPPLSKENIGLNDTLKELFPEEKVKSPFNIKCRFSISTFIDNK<br>GKSTDNTSAEAVKTDGKEDEKDKKNIKRKDLLCFYLFLRLL<br>DENEICKLQHQFIKYRCSLKERRFPGNRTKLEKETELLAELEE<br>LMELVRFTMPSIPEISAKAESGYDTMIKKYFKDFIEKKVFKNP<br>KTSNLYYHSDSKTPVTRKYMALLMRSAPLHLYKDIFKGYYL<br>ITKKECLEYIKLSNIIKDYQNSLNELHEQLERIKLKSEKQNGK<br>DSLYLDKKDFYKVKEYVENLEQVARYKHLQHKINFESLYRI<br>FRIHVDIAARMVGYTQDWERDMHFLFKALVYNGVLEERRF<br>EAIFNNNDDNNDGRIVKKIQNNLNNKNRELVSMLCWNKKL<br>NKNEFGAIIWKRNPIAHLNHFTQTEQNSKSSLESLINSLRILLA |

TABLE 2-continued

| | | |
|---|---|---|
| | | YDRKRQNAVTKTINDLLLNDYHIRIKWEGRVDEGQIYFNIKE<br>KEDIENEPIIHLKHLHKKDCYIYKNSYMFDKQKEWICNGIKE<br>EVYDKSILKCIGNLFKFDYEDKNKSSANPKHT |
| C2-19 | [*Eubacterium*] *rectale* (SEQ ID No. 210) | MLRRDKEVKKLYNVFNQIQVGTKPKKWNNDEKLSPEENER<br>RAQQKNIKMKNYKWREACSKYVESSQRIINDVIFYSYRKAK<br>NKLRYMRKNEDILKKMQEAEKLSKFSGGKLEDFVAYTLRKS<br>LVVSKYDTQEFDSLAAMVVFLECIGKNNISDHEREIVCKLLE<br>LIRKDFSKLDPNVKGSQGANIVRSVRNQNMIVQPQGDRFLFP<br>QVYAKENETVTNKNVEKEGLNEFLLNYANLDDEKRAESLR<br>KLRRILDVYFSAPNHYEKDMDITLSDNIEKEKFNVWEKHEC<br>GKKETGLFVDIPDVLMEAEAENIKLDAVVEKRERKVLNDRV<br>RKQNIICYRYTRAVVEKYNSNEPLFFENNAINQYWIHHIENA<br>VERILKNCKAGKLFKLRKGYLAEKVWKDAINLISIKYIALGK<br>AVYNFALDDIWKDKKNKELGIVDERIRNGITSFDYEMIKAHE<br>NLQRELAVDIAFSVNNLARAVCDMSNLGNKESDFLLWKRN<br>DIADKLKNKDDMASVSAVLQFFGGKSSWDINIFKDAYKGKK<br>KYNYEVRFIDDLRKAIYCARNENFHFKTALVNDEKWNTELF<br>GKIFERETEFCLNVEKDRFYSNNLYMFYQVSELRNMLDHLY<br>SRSVSRAAQVPSYNSVIVRTAFPEYITNVLGYQKPSYDADTL<br>GKWYSACYYLLKEIYYNSFLQSDRALQLFEKSVKTLSWDDK<br>KQQRAVDNFKDHFSDIKSACTSLAQVCQIYMTEYNQQNNQI<br>KKVRSSNDSIFDQPVYQHYKVLLKKAIANAFADYLKNNKDL<br>FGFIGKPFKANEIREIDKEQFLPDWTSRKYEALCIEVSGSQEL<br>QKWYIVGKFLNARSLNLMVGSMRSYIQYVTDIKRRAASIGN<br>ELHVSVHDVEKVEKWVQVIEVCSLLASRTSNQFEDYFNDKD<br>DYARYLKSYVDFSNVDMPSEYSALVDFSNEEQSDLYVDPKN<br>PKVNRNIVHSKLFAADHILRDIVEPVSKDNIEEFYSQKAEIAY<br>CKIKGKEITAEEQKAVLKYQKLKNRVELRDIVEYGEIINELLG<br>QLINWSFMRERDLLYFQLGFHYDCLRNDSKKPEGYKNIKVD<br>ENSIKDAILYQIIGMYVNGVTVYAPEKDGDKLKEQCVKGGV<br>GVKVSAFHRYSKYLGLNEKTLYNAGLEIFEVVAEHEDIINLR<br>NGIDHFKYYLGDYRSMLSIYSEVFDRFFTYDIKYQKNVLNLL<br>QNILLRHNVIVEPILESGFKTIGEQTKPGAKLSIRSIKSDTFQY<br>KVKGGTLITDAKDERYLETIRKILYYAENEEDNLKKSVVVTN<br>ADKYEKNKESDDQNKQKEKKNKDNKGKKNEETKSDAEKN<br>NNERLSYNPFANLNFKLSN |
| C2-20 | Eubacteriaceae bacterium CHKCI004 (SEQ ID No. 211) | MKISKESHKRTAVAVMEDRVGGVVYVPGGSGIDLSNNLKK<br>RSMDTKSLYNVFNQIQAGTAPSEYEWKDYLSEAENKKREAQ<br>KMIQKANYELRRECEDYAKKANLAVSRIIFSKKPKKIFSDDDI<br>ISHMKKQRLSKFKGRMEDFVLIALRKSLVVSTYNQEVFDSR<br>KAATVFLKNIGKKNISADDERQIKQLMALIREDYDKWNPDK<br>DSSDKKESSGTKVIRSIEHQNMVIQPEKNKLSLSKISNVGKKT<br>KTKQKEKAGLDAFLKEYAQIDENSRMEYLKKLRRLLDTYFA<br>APSSYIKGAAVSLPENINFSSELNVWERHEAAKKVNINFVEIP<br>ESLLNAEQNNNKINKVEQEHSLEQLRTDIRRRNITCYHFANA<br>LAADERYHTLFFENMAMNQFWIHHMENAVERILKKCNVGT<br>LFKLRIGYLSEKVWKDMLNLLSIKYIALGKAVYHFALDDIW<br>KADIWKDASDKNSGKINDLTLKGISSFDYEMVKAQEDLQRE<br>MAVGVAFSTNNLARVTCKMDDLSDAESDFLLWNKEAIRRH<br>VKYTEKGEILSAILQFFGGRSLWDESLFEKAYSDSNYELKFL<br>DDLKRAIYAARNETFHFKTAAIDGGSWNTRLFGSLFEKEAGL<br>CLNVEKNKFYSNNLVLFYKQEDLRVFLDKLYGKECSRAAQI<br>PSYNTILPRKSFSDFMKQLLGLKEPVYGSAILDQWYSACYYL<br>FKEVYYNLFLQDSSAKALFEKAVKALKGADKKQEKAVESFR<br>KRYWEISKNASLAEICQSYITEYNQQNNKERKVRSANDGMF<br>NEPIYQHYKMLLKEALKMAFASYIKNDKELKFVYKPTEKLF<br>EVSQDNFLPNWNSEKYNTLISEVKNSPDLQKWYIVGKFMNA<br>RMLNLLLGSMRSYLQYVSDIQKRAAGLGENQLHLSAENVG<br>QVKKWIQVLEVCLLLSVRISDKFTDYFKDEEEYASYLKEYV<br>DFEDSAMPSDYSALLAFSNEGKIDLYVDASNPKVNRNIIQAK<br>LYAPDMVLKKVVKKISQDECKEFNEKKEQIIVIQFKNKGDEVS<br>WEEQQKILEYQKLKNRVELRDLSEYGELINELLGQLINWSYL<br>RERDLLYFQLGFHYSCLMNESKKPDAYKTIRRGTVSIENAVL<br>YQIIAMYINGFPVYAPEKGELKPQCKTGSAGQKIRAFCQWAS<br>MVEKKKYELYNAGLELFEVVKEHDNIIDLRNKIDHFKYYQG<br>NDSILALYGEIFDRFFTYDMKYRNNVLNHLQNILLRHNVIIKP<br>IISKDKKEVGRGKMKDRAAFLLEEVSSDRFTYKVKEGERKID<br>AKNRLYLETVRDILYFPNRAVNDKGEDVIICSKKAQDLNEK<br>KADRDKNHDKSKDTNQKKEGKNQEEKSENKEPYSDRMTW<br>KPFAGIKLE |
| C2-21 | *Blautia* sp. Marseille-P2398 (SEQ ID No. 212) | MKISKVDHVKSGIDQKLSSQRGMLYKQPQKKYEGKQLEEH<br>VRNLSRKAKALYQVFPVSGNSKMEKELQIINSFIKNILLRLDS<br>GKTSEEIVGYINTYSVASQISGDHIQELVDQHLKESLRKYTCV<br>GDKRIYVPDIIVALLKSKFNSETLQYDNSELKILIDFIREDYLK<br>EKQIKQIVHSIENNSTPLRIAEINGQKRLIPANVDNPKKSYIFE<br>FLKEYAQSDPKGQESLLQHMRYLILLYLYGPDKITDDYCEEI<br>EAWNFGSIVMDNEQLFSEEASMLIQDRIYVNQQIEEGRQSKD |

TABLE 2-continued

| | | |
|---|---|---|
| | | TAKVKKNKSKYRMLGDKIEHSINESVVKHYQEACKAVEEK<br>DIPWIKYISDHVMSVYSSKNRVDLDKLSLPYLAKNTWNTWI<br>SFIAMKYVDMGKGVYHFAMSDVDKVGKQDNLIIGQIDPKFS<br>DGISSFDYERIKAEDDLHRSMSGYIAFAVNNFARAICSDEFRK<br>KNRKEDVLTVGLDEIPLYDNVKRKLLQYFGGASNWDDSIIDI<br>IDDKDLVACIKENLYVARNVNFHFAGSEKVQKKQDDILEEIV<br>RKETRDIGKHYRKVFYSNNVAVFYCDEDIIKLMNHLYQREK<br>PYQAQIPSYNKVISKTYLPDLIFMLLKGKNRTKISDPSIMNMF<br>RGTFYFLLKEIYYNDFLQASNLKEMFCEGLKNNVKNKKSEK<br>PYQNFMRRFEELENMGMDFGEICQQIMTDYEQQNKQKKKT<br>ATAVMSEKDKKIRTLDNDTQKYKHFRTLLYIGLREAFIIYLK<br>DEKNKEWYEFLREPVKREQPEEKEFVNKWKLNQYSDCSELI<br>LKDSLAAAWYVVAHFINQAQLNHLIGDIKNYIQFISDIDRRA<br>KSTGNPVSESTEIQIERYRKILRVLEFAKFFCGQITNVLTDYY<br>QDENDFSTHVGHYVKFEKKNMEPAHALQAFSNSLYACGKE<br>KKKAGFYYDGMNPIVNRNITLASMYGNKKLLENAMNPVTE<br>QDIRKYYSLMAELDSVLKNGAVCKSEDEQKNLRHFQNLKN<br>RIELVDVLTLSELVNDLVAQLIGWVYIRERDMMYLQLGLHY<br>IKLYFTDSVAEDSYLRTLDLEEGSIADGAVLYQIASLYSFNLP<br>MYVKPNKSSVYCKKHVNSVATKFDIFEKEYCNGDETVIENG<br>LRLFENINLHKDMVKFRDYLAHFKYFAKLDESILELYSKAYD<br>FFFSYNIKLKKSVSYVLTNVLLSYFINAKLSFSTYKSSGNKTV<br>QHRTTKISVVAQTDYFTYKLRSIVKNKNGVESIENDDRRCEV<br>VNIAARDKEFVDEVCNVINYNSDK |
| C2-22 | *Leptotrichia* sp. oral taxon 879 str. F0557 (SEQ ID No. 213) | MGNLFGHKRWYEVRDKKDFKIKRKVKVKRNYDGNKYILNI<br>NENNNKEKIDNNKFIGEFVNYKKNNNVLKEFKRKFHAGNIL<br>FKLKGKEEIIRIENNDDFLETEEVVLYIEVYGKSEKLKALEITK<br>KKIIDEAIRQGITKDDKKIEIKRQENEEEIEIDIRDEYTNKTLND<br>CSIILRIIENDELETKKSIYEIFKNINMSLYKIIEKIIENETEKVFE<br>NRYYEEHLREKLLKDNKIDVILTNFMEIREKIKSNLEIMGFVK<br>FYLNVSGDKKKSENKKMFVEKILNTNVDLTVEDIVDFIVKEL<br>KFWNITKRIEKVKKFNNEFLENRRNRTYIKSYVLLDKHEKFK<br>IERENKKDKIVKFFVENIKNNSIKEKIEKILAEFKINELIKKLEK<br>ELKKGNCDTEIFGIFKKHYKVNFDSKKFSNKSDEEKELYKIIY<br>RYLKGRIEKILVNEQKVRLKKMEKIEIEKILNESILSEKILKRV<br>KQYTLEHIMYLGKLRHNDIVKMTVNTDDFSRLHAKEELDLE<br>LITFFASTNMELNKIFNGKEKVTDFFGFNLNGQKITLKEKVPS<br>FKLNILKKLNFINNENNIDEKLSHFYSFQKEGYLLRNKILHNS<br>YGNIQETKNLKGEYENVEKLIKELKVSDEEISKSLSLDVIFEG<br>KVDIINKINSLKIGEYKDKKYLPSFSKIVLEITRKFREINKDKL<br>FDIESEKIILNAVKYVNKILYEKITSNEENEFLKTLPDKLVKKS<br>NNKKENKNLLSIEEYYKNAQVSSSKGDKKAIKKYQNKVTNA<br>YLEYLENTFTEIIDFSKFNLNYDEIKTKIEERKDNKSKIIIDSIST<br>NINITNDIEYIISIFALLNSNTYINKIRNRFFATSVWLEKQNGTK<br>EYDYENIISILDEVLLINLLRENNITDILDLKNAIIDAKIVENDE<br>TYIKNYIFESNEEKLKKRLFCEELVDKEDIRKIFEDENFKFKSF<br>IKKNEIGNFKINFGILSNLECNSEVEAKKIIGKNSKKLESFIQNI<br>IDEYKSNIRTLFSSEFLEKYKEEIDNLVEDTESENKNKFEKIYY<br>PKEHKNELYIYKKNLFLNIGNPNFDKIYGLISKDIKNVDTKIL<br>FDDDIKKNKISEIDAILKNLNDKLNGYSNDYKAKYVNKLKE<br>NDDFFAKNIQNENYSSFGEFEKDYNKVSEYKKIRDLVEFNYL<br>NKIESYLIDINWKLAIQMARFERDMHYIVNGLRELGIIKLSGY<br>NTGISRAYPKRNGSDGFYTTTAYYKFFDEESYKKFEKICYGF<br>GIDLSENSEINKPENESIRNYISHFYIVRNPFADYSIAEQIDRVS<br>NLLSYSTRYNNSTYASVFEVFKKDVNLDYDELKKKFRLIGN<br>NDILERLMKPKKVSVLELESYNSDYIKNLIIELLTKIENTNDTL |
| C2-23 | Lachnospiraceae bacterium NK4A144 (SEQ ID No. 214) | MKISKVDHTRMAVAKGNQHRRDEISGILYKDPTKTGSIDFDE<br>RFKKLNCSAKILYHVFNGIAEGSNKYKNIVDKVNNNLDRVL<br>FTGKSYDRKSIIDIDTVLRNVEKINAFDRISTEEREQIIDDLLEI<br>QLRKGLRKGKAGLREVLLIGAGVIVRTDKKQEIADFLEILDE<br>DFNKTNQAKNIKLSIENQGLVVSPVSRGEERIFDVSGAQKGK<br>SSKKAQEKEALSAFLLDYADLDKNVRFEYLRKIRRLINLYFY<br>VKNDDVMSLTEIPAEVNLEKDFDIWRDHEQRKEENGDFVGC<br>PDILLADRDVKKSNSKQVKIAERQLRESIREKNIKRYRFSIKTI<br>EKDDGTYFFANKQISVFWIHRIENAVERILGSINDKKLYRLRL<br>GYLGEKVWKDILNFLSIKYIAVGKAVFNFAMDDLQEKDRDI<br>EPGKISENAVNGLTSFDYEQIKADEMLQREVAVNVAFAANN<br>LARVTVDIPQNGEKEDILLWNKSDIKKYKKNSKKGILKSILQ<br>FFGGASTWNMKMFEIAYHDQPGDYEENYLYDIIQIIYSLRNK<br>SFHFKTYDHGDKNWNRELIGKMIEHDAERVISVEREKFHSN<br>NLPMFYKDADLKKILDLLYSDYAGRASQVPAFNTVLVRKNF<br>PEFLRKDMGYKVHFNNPEVENQWHSAVYYLYKEIYYNLFL<br>RDKEVKNLFYTSLKNIRSEVSDKKQKLASDDFASRCEEIEDR<br>SLPEICQIIMTEYNAQNFGNRKVKSQRVIEKNKDIFRHYKML<br>LIKTLAGAFSLYLKQERFAFIGKATPIPYETTDVKNFLPEWKS<br>GMYASFVEEIKNNLDLQEWYIVGRFLNGRMLNQLAGSLRSY<br>IQYAEDIERRAAENRNKLFSKPDEKIEACKKAVRVLDLCIKIS<br>TRISAEFTDYFDSEDDYADYLEKYLKYQDDAIKELSGSSYAA |

TABLE 2-continued

| | | |
|---|---|---|
| | | LDHFCNKDDLKFDIYVNAGQKPILQRNIVMAKLFGPDNILSE<br>VMEKVTESAIREYYDYLKKVSGYRVRGKCSTEKEQEDLLKF<br>QRLKNAVEFRDVTEYAEVINELLGQLISWSYLRERDLLYFQL<br>GFHYMCLKNKSFKPAEYVDIRRNNGTIIHNAILYQIVSMYIN<br>GLDFYSCDKEGKTLKPIETGKGVGSKIGQFIKYSQYLYNDPS<br>YKLEIYNAGLEVFENIDEHDNITDLRKYVDHFKYYAYGNKM<br>SLLDLYSEFFDRFFTYDMKYQKNVVNVLENILLRHFVIFYPK<br>FGSGKKDVGIRDCKKERAQIEISEQSLTSEDFMFKLDDKAGE<br>EAKKFPARDERYLQTIAKLLYYPNEIEDMNRFMKKGETINK<br>KVQFNRKKKITRKQKNNSSNEVLSSTMGYLFKNIKL |
| C2-24 | *Chloroflexus aggregans* (SEQ ID No. 215) | MTDQVRREEVAAGELADTPLAAAQTPAADAAVAATPAPAE<br>AVAPTPEQAVDQPATTGESEAPVTTAQAAAHEAEPAEATGA<br>SFTPVSEQQPQKPRRLKDLQPGMELEGKVTSIALYGIFVDVG<br>VGRDGLVHISEMSDRRIDTPSELVQIGDTVKVWVKSVDLDA<br>RRISLTMLNPSRGEKPRRSRQSQPAQPQPRRQEVDREKLASL<br>KVGEIVEGVITGFAPFGAFADIGVGKDGLIHISELSEGRVEKP<br>EDAVKVGERYQFKVLEIDGEGTRISLSLRRAQRTQRMQQLEP<br>GQIIEGTVSGIATFGAFVDIGVGRDGLVHISALAPHRVAKVED<br>VVKVGDKVKVKVLGVDPQSKRISLTMRLEEEQPATTAGDEA<br>AEPAEEVTPTRRGNLERFAAAAQTARERSERGERSERGERRE<br>RRERRPAQSSPDTYIVGEDDDESFEGNATIEDLLTKFGGSSSR<br>RDRDRRRRHEDDDDEEMERPSNRRQREAIRRTLQQIGYDE |
| C2-25 | *Demequina aurantiaca* (SEQ ID No. 216) | MDLTWHALLILFIVALLAGFLDTLAGGGGLLTVPALLLTGIP<br>PLQALGTNKLQSSFGTGMATYQVIRKKRVHWRDVRWPMV<br>WAFLGSAAGAVAVQFIDTDALLIIIPVVLALVAAYFLFVPKS<br>HLPPPEPRMSDPAYEATLVPIIGAYDGAFGPGTGSLYALSGV<br>ALRAKTLVQSTAIAKTLNFATNFAALLVFAFAGHMLWTVGA<br>VMIAGQLIGAYAGSHMLFRVNPLVLRVLIVVMSLGMLIRVL<br>LD |
| C2-26 | *Thalassospira* sp. TSL5-1 (SEQ ID No. 217) | MRIIKPYGRSHVEGVATQEPRRKLRLNSSPDISRDIPGFAQSH<br>DALIIAQWISAIDKIATKPKPDKKPTQAQINLRTTLGDAAWQ<br>HVMAENLLPAATDPAIREKLHLIWQSKIAPWGTARPQAEKD<br>GKPTPKGGWYERFCGVLSPEAITQNVARQIAKDIYDHLHVA<br>AKRKGREPAKQGESSNKPGKFKPDRKRGLIEERAESIAKNAL<br>RPGSHAPCPWGPDDQATYEQAGDVAGQIYAAARDCLEEKK<br>RRSGNRNTSSVQYLPRDLAAKILYAQYGRVFGPDTTIKAALD<br>EQPSLFALHKAIKDCYHRLINDARKRDILRILPRNMAALFRL<br>VRAQYDNRDINALIRLGKVIHYHASEQGKSEHHGIRDYWPS<br>QQDIQNSRFWGSDGQADIKRHEAFSRIWRHIIALASRTLHDW<br>ADPHSQKFSGENDDILLLAKDAIEDDVFKAGHYERKCDVLF<br>GAQASLFCGAEDFEKAILKQAITGTGNLRNATFHFKGKVRFE<br>KELQELTKDVPVEVQSAIAALWQKDAEGRTRQIAETLQAVL<br>AGHFLTEEQNRHIFAALTAAMAQPGDVPLPRLRRVLARHDSI<br>CQRGRILPLSPCPDRAKLEESPALTCQYTVLKMLYDGPFRAW<br>LAQQNSTILNHYIDSTIARTDKAARDMNGRKLAQAEKDLITS<br>RAADLPRLSVDEKMGDFLARLTAATATEMRVQRGYQSDGE<br>NAQKQAAFIGQFECDVIGRAFADFLNQSGFDFVLKLKADTP<br>QPDAAQCDVTALIAPDDISVSPPQAWQQVLYFILHLVPVDDA<br>SHLLHQIRKWQVLEGKEKPAQIAHDVQSVLMLYLDMHDAK<br>FTGGAALHGIEKFAEFFAHAADFRAVFPPQSLQDQDRSIPRR<br>GLREIVRFGHLPLLQHMSGTVQITHDNVVAWQAARTAGAT<br>GMSPIARRQKQREELHALAVERTARFRNADLQNYMHALVD<br>VIKHRQLSAQVTLSDQVRLHRLMMGVLGRLVDYAGLWERD<br>LYFVVLALLYHHGATPDDVFKGQGKKNLADGQVVAALKPK<br>NRKAAAPVGVFDDLDHYGIYQDDRQSIRNGLSHFNMLRGG<br>KAPDLSHWVNQTRSLVAHDRKLKNAVAKSVIEMLAREGFD<br>LDWGIQTDRGQHILSHGKIRTRQAQHFQKSRLHIVKKSAKPD<br>KNDTVKIRENLHGDAMVERVVQLFAAQVQKRYDITVEKRL<br>DHLFLKPQDQKGKNGIHTHNGWSKTEKKRRPSRENRKGNH<br>EN |
| C2-27 | SAMN04487830_13920 [*Pseudobutyrivibrio* sp. OR37] (SEQ ID No. 218) | MKFSKESHRKTAVGVTESNGIIGLLYKDPLNEKEKIEDVVNQ<br>RANSTKRLFNLFGTEATSKDISRASKDLAKVVNKAIGNLKGN<br>KKFNKKEQITKGLNTKIIVEELKNVLKDEKKLIVNKDIIDEAC<br>SRLLKTSFRTAKTKQAVKMILTAVLIENTNLSKEDEAFVHEY<br>FVKKLVNEYNKTSVKKQIPVALSNQNMVIQPNSVNGTLEISE<br>TKKSKETKTTEKDAFRAFLRDYATLDENRRHKMRLCLRNLV<br>NLYFYGETSVSKDDFDEWRDHEDKKQNDELFVKKIVSIKTD<br>RKGNVKEVLDVDATIDAIRTNNIACYRRALAYANENPDVFF<br>SDTMLNKFWIHHVENEVERIYGHINNNTGDYKYQLGYLSEK<br>VWKGIINYLSIKYIAEGKAVYNYAMNALAKDNNSNAFGKLD<br>EKFVNGITSFEYERIKAEETLQRECAVNIAFAANHLANATVD<br>LNEKDSDFLLLKHEDNKDTLGAVARPNILRNILQFFGGKSRW<br>NDFDFSGIDEIQLLDDLRKMIYSLRNSSFHFKTENIDNDSWNT<br>KLIGDMFAYDFNMAGNVQKDKMYSNNVPMFYSTSDIEKML<br>DRLYAEVHERASQVPSFNSVFVRKNFPDYLKNDLKITSAFGV<br>DDALKWQSAVYYVCKEIYYNDFLQNPETFTMLKDYVQCLPI |

TABLE 2-continued

| | | |
|---|---|---|
| | | DIDKSMDQKLKSERNAHKNFKEAFATYCKECDSLSAICQMI<br>MTEYNNQNKGNRKVISARTKDGDKLIYKHYKMILFEALKN<br>VFTIYLEKNINTYGFLKKPKLINNVPAIEEFLPNYNGRQYETL<br>VNRITEETELQKWYIVGRLLNPKQVNQLIGNFRSYVQYVND<br>VARRAKQTGNNLSNDNIAWDVKNIIQIFDVCTKLNGVTSNIL<br>EDYFDDGDDYARYLKNFVDYTNKNNDHSATLLGDFCAKEI<br>DGIKIGIYHDGTNPIVNRNIIQCKLYGATGIISDLTKDGSILSV<br>DYEIIKKYMQMQKEIKVYQQKGICKTKEEQQNLKKYQELKN<br>IVELRNIIDYSEILDELQGQLINWGYLRERDLMYFQLGFHYLC<br>LHNESKKPVGYNNAGDISGAVLYQIVAMYTNGLSLIDANGK<br>SKKNAKASAGAKVGSFCSYSKEIRGVDKDTKEDDDPIYLAG<br>VELFENINEHQQCINLRNYIEHFHYYAKHDRSMLDLYSEVFD<br>RFFTYDMKYTKNVPNMMYNILLQHLVVPAFEFGSSEKRLDD<br>NDEQTKPRAMFTLREKNGLSSEQFTYRLGDGNSTVKLSARG<br>DDYLRAVASLLYYPDRAPEGLIRDAEAEDKFAKINHSNPKSD<br>NRNNRGNFKNPKVQWYNNKTKRK |
| C2-28 | SAMN02910398_00008<br>[*Butyrivibrio* sp.<br>YAB3001]<br>(SEQ ID<br>No. 219) | MKISKVDHRKTAVKITDNKGAEGFIYQDPTRDSSTMEQIISN<br>RARSSKVLFNIFGDTKKSKDLNKYTESLIIYVNKAIKSLKGDK<br>RNNKYEEITESLKTERVLNALIQAGNEFTCSENNIEDALNKY<br>LKKSFRVGNTKSALKKLLMAAYCGYKLSIEEKEEIQNYFVD<br>KLVKEYNKDTVLKYTAKSLKHQNMVVQPDTDNHVFLPSRI<br>AGATQNKMSEKEALTEFLKAYAVLDEEKRHNLRIILRKLVN<br>LYFYESPDFIYPENNEWKEHDDRKNKTETFVSPVKVNEEKN<br>GKTFVKIDVPATKDLIRLKNIECYRRSVAETAGNPITYFTDHN<br>ISKFWIHHIENEVEKIFALLKSNWKDYQFSVGYISEKVWKEII<br>NYLSIKYIAIGKAVYNYALEDIKKNDGTLNFGVIDPSFYDGIN<br>SFEYEKIKAEETFQREVAVYVSFAVNHLSSATVKLSEAQSDM<br>LVLNKNDIEKIAYGNTKRNILQFFGGQSKWKEFDFDRYINPV<br>NYTDIDFLFDIKKMVYSLRNESFHFTTTDTESDWNKNLISAM<br>FEYECRRISTVQKNKFFSNNLPLFYGENSLERVLHKLYDDYV<br>DRMSQVPSFGNVFVRKKFPDYMKEIGIKHNLSSEDNLKLQG<br>ALYFLYKEIYYNAFISSEKAMKIFVDLVNKLDTNARDDKGRI<br>THEAMAHKNFKDAISHYMTHDCSLADICQKIMTEYNQQNT<br>GHRKKQTTYSSEKNPEIFRHYKMILFMLLQKAMTEYISSEEIF<br>DFIMKPNSPKTDIKEEEFLPQYKSCAYDNLIKLIADNVELQK<br>WYITARLLSPREVNQLIGSFRSYKQFVSDIERRAKETNNSLSK<br>SGMTVDVENITKVLDLCTKLNGRFSNELTDYFDSKDDYAVY<br>VSKFLDFGFKIDEKFPAALLGEFCNKEENGKKIGIYHNGTEPI<br>LNSNIIKSKLYGITDVVSRAVKPVSEKLIREYLQQEVKIKPYL<br>ENGVCKNKEEQAALRKYQELKNRIEFRDIVEYSEIINELMGQ<br>LINFSYLRERDLMYFQLGFHYLCLNNYGAKPEGYYSIVNDK<br>RTIKGAILYQIVAMYTYGLPIYHYVDGTISDRRKNKKTVLDT<br>LNSSETVGAKIKYFIYYSDELFNDSLILYNAGLELFENINEHE<br>NIVNLRKYIDHFKYYVSQDRSLLDIYSEVFDRYFTYDRKYKK<br>NVMNLFSNIMLKHFIITDFEFSTGEKTIGEKNTAKKECAKVRI<br>KRGGLSSDKFTYKFKDAKPIELSAKNTEFLDGVARILYYPEN<br>VVLTDLVRNSEVEDEKRIEKYDRNHNSSPTRKDKTYKQDVK<br>KNYNKKTSKAFDSSKLDTKSVGNNLSDNPVLKQFLSESKKK<br>R |
| C2-29 | *Blautia* sp.<br>Marseille-<br>P2398<br>(SEQ ID<br>No. 220) | MKISKVDHVKSGIDQKLSSQRGMLYKQPQKKYEGKQLEEH<br>VRNLSRKAKALYQVFPVSGNSKMEKELQIINSFIKNILLRLDS<br>GKTSEEIVGYINTYSVASQISGDHIQELVDQHLKESLRKYTCV<br>GDKRIYVPDIIVALLKSKFNSETLQYDNSELKILIDFIREDYLK<br>EKQIKQIVHSIENNSTPLRIAEINGQKRLIPANVDNPKKSYIFE<br>FLKEYAQSDPKGQESLLQHMRYLILLYLYGPDKITDDYCEEI<br>EAWNFGSIVMDNEQLFSEEASMLIQDRIYVNQQIEEGRQSKD<br>TAKVKKNKSKYRMLGDKIEHSINESVVKHYQEACKAVEEK<br>DIPWIKYISDHVMSVYSSKNRVDLDKLSLPYLAKNTWNTWI<br>SFIAMKYVDMGKGVYHFAMSDVDKVGKQDNLIIGQIDPKFS<br>DGISSFDYERIKAEDDLHRSMSGYIAFAVNNFARAICSDEFRK<br>KNRKEDVLTVGLDEIPLYDNVKRKLLQYFGGASNWDDSIIDI<br>IDDKDLVACIKENLYVARNVNFHFAGSEKVQKKQDDILEEIV<br>RKETRDIGKHYRKVFYSNNVAVFYCDEDIIKLMNHLYQREK<br>PYQAQIPSYNKVISKTYLPDLIFMLLKGKNRTKISDPSIMNMF<br>RGTFYFLLKEIYYNDFLQASNLKEMFCEGLKNNVKNKKSEK<br>PYQNFMRRFEELENMGMDFGEICQQIMTDYEQQNKQKKKT<br>ATAVMSEKDKKIRTLDNDTQKYKHFRTLLYIGLREAFIIYLK<br>DEKNKEWYEFLREPVKREQPEEKEFVNKWKLNQYSDCSELI<br>LKDSLAAAWYVVAHFINQAQLNHLIGDIKNYIQFISDIDRRA<br>KSTGNPVSESTEIQIERYRKILRVLEFAKFFCGQITNVLTDYY<br>QDENDFSTHVGHYVKFEKKNMEPAHALQAFSNSLYACGKE<br>KKKAGFYYDGMNPIVNRNITLASMYGNKKLLENAMNPVTE<br>QDIRKYYSLMAELDSVLKNGAVCKSEDEQKNLRHFQNLKN<br>RIELVDVLTLSELVNDLVAQLIGWVYIRERDMMYLQLGLHY<br>IKLYFTDSVAEDSYLRTLDLEEGSIADGAVLYQIASLYSFNLP<br>MYVKPNKSSVYCKKHVNSVATKFDIFEKEYCNGDETVIENG<br>LRLFENINLHKDMVKFRDYLAHFKYFAKLDESILELYSKAYD<br>FFFSYNIKLKKSVSYVLTNVLLSYFINAKLSFSTYKSSGNKTV |

TABLE 2-continued

| | | |
|---|---|---|
| | | QHRTTKISVVAQTDYFTYKLRSIVKNKNGVESIENDDRRCEV<br>VNIAARDKEFVDEVCNVINYNSDK |
| C2-30 | *Leptotrichia* sp. Marseille-P3007 (SEQ ID No. 221) | MKITKIDGISHKKYIKEGKLVKSTSEENKTDERLSELLTIRLD<br>TYIKNPDNASEEENRIRRENLKEFFSNKVLYLKDGILYLKDR<br>REKNQLQNKNYSEEDISEYDLKNKNNFLVLKKILLNEDINSE<br>ELEIFRNDFEKKLDKINSLKYSLEENKANYQKINENNIKKVE<br>GKSKRNIFYNYYKDSAKRNDYINNIQEAFDKLYKKEDIENLF<br>FLIENSKKHEKYKIRECYHKIIGRKNDKENFATIIYEEIQNVNN<br>MKELIEKVPNVSELKKSQVFYKYYLNKEKLNDENIKYVFCH<br>FVEIEMSKLLKNYVYKKPSNISNDKVKRIFEYQSLKKLIENKL<br>LNKLDTYVRNCGKYSFYLQDGEIATSDFIVGNRQNEAFLRNI<br>IGVSSTAYFSLRNILETENENDITGRMRGKTVKNNKGEEKYIS<br>GEIDKLYDNNKQNEVKKNLKMFYSYDFNMNSKKEIEDFFSN<br>IDEAISSIRHGIVHFNLELEGKDIFTFKNIVPSQISKKMFHDEIN<br>EKKLKLKIFKQLNSANVFRYLEKYKILNYLNRTRFEFVNKNI<br>PFVPSFTKLYSRIDDLKNSLGIYWKTPKTNDDNKTKEITDAQI<br>YLLKNIYYGEFLNYFMSNNGNFFEITKEIIELNKNDKRNLKT<br>GFYKLQKFENLQEKTPKEYLANIQSLYMINAGNQDEEEKDT<br>YIDFIQKIFLKGFMTYLANNGRLSLIYIGSDEETNTSLAEKKQ<br>EFDKFLKKYEQNNNIEIPYEINEFVREIKLGKILKYTERLNMF<br>YLILKLLNHKELTNLKGSLEKYQSANKEEAFSDQLELINLLN<br>LDNNRVTEDFELEADEIGKFLDFNGNKVKDNKELKKFDTNK<br>IYFDGENIIKHRAFYNIKKYGMLNLLEKISDEAKYKISIEELKN<br>YSKKKNEIEENHTTQENLHRKYARPRKDEKFTDEDYKKYEK<br>AIRNIQQYTHLKNKVEFNELNLLQSLLLRILHRLVGYTSIWER<br>DLRFRLKGEFPENQYIEEIFNFDNSKNVKYKNGQIVEKYINFY<br>KELYKDDTEKISIYSDKKVKELKKEKKDLYIRNYIAHFNYIPN<br>AEISLLEMLENLRKLLSYDRKLKNAIMKSIVDILKEYGFVVTF<br>KIEKDKKIRIESLKSEEVVHLKKLKLKDNDKKKEPIKTYRNS<br>KELCKLVKVMFEYKMKEKKSEN |
| C2-31 | *Bacteroides ihuae* (SEQ ID No. 222) | MRITKVKVKESSDQKDKMVLIHRKVGEGTLVLDENLADLTA<br>PIIDKYKDKSFELSLLKQTLVSEKEMNIPKCDKCTAKERCLSC<br>KQREKRLKEVRGAIEKTIGAVIAGRDIIPRLNIFNEDEICWLIK<br>PKLRNEFTFKDVNKQVVKLNLPKVLVEYSKKNDPTLFLAYQ<br>QWIAAYLKNKKGHIKKSILNNRVVIDYSDESKLSKRKQALEL<br>WGEEYETNQRIALESYHTSYNIGELVTLLPNPEEYVSDKGEIR<br>PAFHYKLKNVLQMHQSTVFGTNEILCINPIFNENRANIQLSAY<br>NLEVVKYFEHYFPIKKKKKNLSLNQAIYYLKVETLKERLSLQ<br>LENALRMNLLQKGKIKKHEFDKNTCSNTLSQIKRDEFFVLNL<br>VEMCAFAANNIRNIVDKEQVNEILSKKDLCNSLSKNTIDKEL<br>CTKFYGADFSQIPVAIWAMRGSVQQIRNEIVHYKAEAIDKIF<br>ALKTFEYDDMEKDYSDTPFKQYLELSIEKIDSFFIEQLSSNDV<br>LNYYCTEDVNKLLNKCKLSLRRTSIPFAPGFKTIYELGCHLQ<br>DSSNTYRIGHYLMLIGGRVANSTVTKASKAYPAYRFMLKLI<br>YNHLFLNKFLDNHNKRFFMKAVAFVLKDNRENARNKFQYA<br>FKEIRMMNNDESIASYMSYIHSLSVQEQEKKGDKNDKVRYN<br>TEKFIEKVFVKGFDDFLSWLGVEFILSPNQEERDKTVTREEYE<br>NLMIKDRVEHSINSNQESHIAFFTFCKLLDANHLSDLRNEWI<br>KFRSSGDKEGFSYNFAIDIIELCLLTVDRVEQRRDGYKEQTEL<br>KEYLSFFIKGNESENTVWKGFYFQQDNYTPVLYSPIELIRKY<br>GTLELLKLIIVDEDKITQGEFEEWQTLKKVVEDKVTRRNELH<br>QEWEDMKNKSSFSQEKCSIYQKLCRDIDRYNWLDNKLHLV<br>HLRKLHNLVIQILSRMARFIALWDRDFVLLDASRANDDYKL<br>LSFFNFRDFINAKKTKTDDELLAEFGSKIEKKNAPFIKAEDVP<br>LMVECIEAKRSFYQKVFFRNNLQVLADRNFIAHYNYISKTAK<br>CSLFEMIIKLRTLMYYDRKLRNAVVKSIANVFDQNGMVLQL<br>SLDDSHELKVDKVISKRIVHLKNNNIMTDQVPEEYYKICRRL<br>LEMKK |
| C2-32 | SAMN05216357_1045 [Porphyromonadaceae bacterium KH3CP3RA] (SEQ ID No. 223) | MEFRDSIFKSLLQKEIEKAPLCFAEKLISGGVFSYYPSERLKEF<br>VGNHPFSLFRKTMPFSPGFKRVMKSGGNYQNANRDGRFYD<br>LDIGVYLPKDGFGDEEWNARYFLMKLIYNQLFLPYFADAEN<br>HLFRECVDFVKRVNRDYNCKNNNSEEQAFIDIRSMREDESIA<br>DYLAFIQSNIIIEENKKKETNKEGQINFNKFLLQVFVKGFDSFL<br>KDRTELNFLQLPELQGDGTRGDDLESLDKLGAVVAVDLKLD<br>ATGIDADLNENISFYTFCKLLDSNHLSRLRNEIIKYQSANSDF<br>SHNEDFDYDRIISIIELCMLSADHVSTNDNESIFPNNDKDFSGI<br>RPYLSTDAKVETFEDLYVHSDAKTPITNATMVLNWKYGTDK<br>LFERLMISDQDFLVTEKDYFVWKELKKDIEEKIKLREELHSL<br>WVNTPKGKKGAKKKNGRETTGEFSEENKKEYLEVCREIDRY<br>VNLDNKLHFVHLKRMHSLLIELLGRFVGFTYLFERDYQYYH<br>LEIRSRRNKDAGVVDKLEYNKIKDQNKYDKDDFFACTFLYE<br>KANKVRNFIAHFNYLTMWNSPQEEEHNSNLSGAKNSSGRQN<br>LKCSLTELINELREVMSYDRKLKNAVTKAVIDLFDKHGMVI<br>KFRIVNNNNNDNKNKHHLELDDIVPKKIMHLRGIKLKRQDG<br>KPIPIQTDSVDPLYCRMWKKLLDLKPTPF |

TABLE 2-continued

| | | |
|---|---|---|
| C2-33 | *Listeria riparia* (SEQ ID No. 224) | MHDAWAENPKKPQSDAFLKEYKACCEAIDTYNWHKNKAT LVYVNELHHLLIDILGRLVGYVAIADRDFQCMANQYLKSSG HTERVDSWINTIRKNRPDYIEKLDIFMNKAGLFVSEKNGRNY IAHLNYLSPKHKYSLLYLFEKLREMLKYDRKLKNAVTKSLID LLDKHGMCVVFANLKNNKHRLVIASLKPKKIETFKWKKIK |
| C2-34 | *Insolitispinillum peregrinum* (SEQ ID No. 225) | MRIIRPYGSSTVASPSPQDAQPLRSLQRQNGTFDVAEFSRRHP ELVLAQWVAMLDKIIRKPAPGKNSTALPRPTAEQRRLRQQV GAALWAEMQRHTPVPPELKAVWDSKVHPYSKDNAPATAKT PSHRGRWYDRFGDPETSAATVAEGVRRHLLDSAQPFRANGG QPKGKGVIEHRALTIQNGTLLHHHQSEKAGPLPEDWSTYRA DELVSTIGKDARWIKVAASLYQHYGRIFGPTTPISEAQTRPEF VLHTAVKAYYRRLFKERKLPAERLERLLPRTGEALRHAVTV QHGNRSLADAVRIGKILHYGWLQNGEPDPWPDDAALYSSR YWGSDGQTDIKHSEAVSRVWRRALTAAQRTLTSWLYPAGT DAGDILLIGQKPDSIDRNRLPLLYGDSTRHWTRSPGDVWLFL KQTLENLRNSSFHFKTLSAFTSHLDGTCESEPAEQQAAQALW QDDRQQDHQQVFLSLRALDATTYLPTGPLHRIVNAVQSTDA TLPLPRFRRVVTRAANTRLKGFPVEPVNRRTMEDDPLLRCR YGVLKLLYERGFRAWLETRPSIASCLDQSLKRSTKAAQTING KNSPQGVEILSRATKLLQAEGGGGHGIHDLFDRLYAATARE MRVQVGYHHDAEAARQQAEFIEDLKCEVVARAFCAYLKTL GIQGDTFRRQPEPLPTWPDLPDLPSSTIGTAQAALYSVLHLMP VEDVGSLLHQLRRWLVALQARGGEDGTAITATIPLLELYLN RHDAKFSGGGAGTGLRWDDWQVFEDCQATFDRVFPPGPAL DSHRLPLRGLREVLRFGRVNDLAALIGQDKITAAEVDRWHT AEQTIAAQQQRREALHEQLSRKKGTDAEVDEYRALVTAIAD HRHLTAHVTLSNVVRLHRLMTTVLGRLVDYGGLWERDLTF VTLYEAHRLGGLRNLLSESRVNKFLDGQTPAALSKKNNAEE NGMISKVLGDKARRQIRNDFAHFNMLQQGKKTINLTDEINN ARKLMAHDRKLKNAITRSVTTLLQQDGLDIVWTMDASHRL TDAKIDSRNAIHLHKTHNRANIREPLHGKSYCRWVAALFGA TSTPSATKKSDKIR |

In certain example embodiments, the RNA-targeting effector protein is a Cas13c effector protein as disclosed in U.S. Provisional Patent Application No. 62/525,165 filed Jun. 26, 2017, and PCT Application No. US 2017/047193 filed Aug. 16, 2017. Example wildtype orthologue sequences of Cas13c are provided in Table 4 below. In certain example embodiments, the CRISPR effector protein is a Cas13c protein from Table 3 or 4.

TABLE 3

| | |
|---|---|
| *Fusobacterium necrophorum* subsp. *funduliforme* ATCC 51357 contig00003 (SEQ ID No. 226) | MEKFRRQNRNSIIKIIISNYDTKGIKELKVRYRKQAQLDTFIIKTEI VNNDIFIKSIIEKAREKYRYSFLFDGEEKYHFKNKSSVEIVKKDIF SQTPDNMIRNYKITLKISEKNPRVVEAEIEDLMNSTILKDGRRSA RREKSMTERKLIEEKVAKNYSLLANCPMEEVDSIKIYKIKRFLT YRSNMLLYFASINSFLCEGIKGKDNETEEIWHLKDNDVRKEKV RENFKNKLIQSTENYNSSLKNQIEEKEKLLRKEFKKGAFYRTIIK KLQQERIKELSEKSLTEDCEKIIKLYSKLRHSLMHYDYQYFENLF ENKKNDDLMKDLNLDLFKSLPLIRKMKLNNKVNYLEDGDTLF VLQKTKKAKTLYQIYDALCEQKNGFNKFINDFFVSDGEENTVF KQIINEKFQSEMEFLEKRISESEKKNEKLKKKLDSMKAHFRNINS EDTKEAYFWDIHSSRNYKTKYNERKNLVNEYTELLGSSKEKKL LREEITKINRQLLKLKQEMEEITKKNSLFRLEYKMKIAFGFLFCE FDGNISKFKDEFDASNQEKIIQYHKNGEKYLTSFLKEEEKEKFNL EKMQKIIQKTEEEDWLLPETKNNLFKFYLLTYLLLPYELKGDFL GFVKKHYYDIKNVDFIDENQNNIQVSQTVEKQEDYFYHKIRLFE KNTKKYEIVKYSIVPNEKLKQYFEDLGIDIKYLTVEQKSEVSEEK NKKVSLKNNGMFNKTILLFVFKYYQIAFKLFNDIELYSLFFLRE KSGKPLEIFRKELESKMKDGYLNFGQLLYVVYEVLVKNKDLDK ILSKKIDYRKDKSFSPEIAYLRNFLSHLNYSKFLDNFMKINTNKS DENKEVLIPSIKIQKMIQFIEKCNLQNQIDFDFNFVNDFYMRKEK MFFIQLKQIFPDINSTEKQKMNEKEEILRNRYHLTDKKNEQIKDE HEAQSQLYEKILSLQKIYSSDKNNFYGRLKEEKLLFLEKQGKKK LSMEEIKDKIAGDISDLLGILKKEITRDIKDKLTEKFRYCEEKLLN LSFYNHQDKKKEESIRVFLIRDKNSDNFKFESILDDGSNKIFISKN GKEITIQCCDKVLETLIIEKNTLKISSNGKIISLIPHYSYSIDVKY |
| *Fusobacterium necrophorum* DJ-2 contig0065, whole genome shotgun sequence (SEQ ID No. 227) | MEKFRRQNRSSIIKIIISNYDTKGIKELKVRYRKQAQLDTFIIKTEI VNNDIFIKSBEKAREKYRYSFLFDGEEKYHFKNKSSVEIVKKDIF SQTPDNMIRNYKITLKISEKNPRVVEAEIEDLMNSTILKDGRRSA RREKSMTERKLIEEKVAENYSLLANCPMEEVDSIKIYKIKRFLTY RSNMLLYFASINSFLCEGIKGKDNETEEIWHLKDNDVRKEKVKE NFKNKLIQSTENYNSSLKNQIEEKEKLLRKESKKGAFYRTIIKKL QQERIKELSEKSLTEDCEKIIKLYSELRHPLMHYDYQYFENLFEN KENSELTKNLNLDIFKSLPLVRKMKLNNKVNYLEDNDTLFVLQ KTKKAKTLYQIYDALCEQKNGFNKFINDFFVSDGEENTVFKQII |

TABLE 3-continued

| | |
|---|---|
| | NEKFQSEIEFLEKRISESEKKNEKLKKKLDSMKAHFRNINSEDTK<br>EAYFWDIHSSRNYKTKYNERKNLVNEYTELLGSSKEKKLLREEI<br>TKINRQLLKLKQEMEEITKKNSLFRLEYKMKMAFGFLFCEFDG<br>NISRFKDEFDASNQEKIIQYHKNGEKYLTYFLKEEEKEKFNLKK<br>LQETIQKTGEENWLLPQNKNNLFKFYLLTYLLLPYELKGDFLGF<br>VKKHYYDIKNVDFMDENQSSKIIESKEDDFYHKIRLFEKNTKKY<br>EIVKYSIVPDKKLKQYFKDLGIDTKYLILDQKSEVSGEKNKKVS<br>LKNNGMFNKTILLFVFKYYQIAFKLFNDIELYSLFFLREKSGKPF<br>EVFLKELKDKMIGKQLNFGQLLYVVYEVLVKNKDLSEILSERID<br>YRKDMCFSAEIADLRNFLSHLNYSKFLDNFMKINTNKSDENKE<br>VLIPSIKIQKMIKFIEECNLQSQIDFDFNFVNDFYMRKEKMFFIQL<br>KQIFPDINSTEKQKMNEKEEILRNRYHLTDKKNEQIKDEHEAQS<br>QLYEKILSLQKIYSSDKNNFYGRLKEEKLLFLEKQEKKKLSMEEI<br>KDKIAGDISDLLGILKKEITRDIKDKLTEKFRYCEEKLLNLSFYN<br>HQDKKKEESIRVFLIRDKNSDNFKFESILDDGSNKIFISKNGKEIT<br>IQCCDKVLETLIIEKNTLKISSNGKIISLIPHYSYSIDVKY |
| *Fusobacterium necrophorum* BFTR-1 contig0068 (SEQ ID No. 228) | MKVRYRKQAQLDTFIIKTEIVNNDIFIKSIIEKAREKYRYSFLFDG<br>EEKYHFKNKSSVEIVKNDIFSQTPDNMIRNYKITLKISEKNPRVV<br>EAEIEDLMNSTILKDGRRSARREKSMTERKLIEEKVAENYSLLA<br>NCPIEEVDSIKIYKIKRFLTYRSNMLLYFASINSFLCEGIKGKDNE<br>TEEIWHLKDNDVRKEKVKENFKNKLIQSTENYNSSLKNQIEEKE<br>KLSSKEFKKGAFYRTIIKKLQQERIKELSEKSLTEDCEKIIKLYSE<br>LRHPLMHYDYQYFENLFENKENSELTKNLNLDIFKSLPLVRKM<br>KLNNKVNYLEDNDTLFVLQKTKKAKTLYQIYDALCEQKNGFN<br>KFINDFFVSDGEENTVFKQIINEKFQSEMEFLEKRISESEKKNEKL<br>KKKLDSMKAHFRNINSEDTKEAYFWDIHSSRNYKTKYNERKNL<br>VNEYTKLLGSSKEKKLLREEITKINRQLLKLKQEMEEITKKNSLF<br>RLEYKMKIAFGFLFCEFDGNISKFKDEFDASNQEKIIQYHKNGE<br>KYLTSFLKEEEKEKFNLEKMQKIIQKTEEEDWLLPETKNNLFKF<br>YLLTYLLLPYELKGDFLGFVKKHYYDIKNVDFMDENQNNIQVS<br>QTVEKQEDYFYHKIRLFEKNTKKYEIVKYSIVPNEKLKQYFEDL<br>GIDIKYLTGSVESGEKWLGENLGIDIKYLTVEQKSEVSEEKNKK<br>VSLKNNGMFNKTILLFVFKYYQIAFKLFNDIELYSLFFLREKSEK<br>PFEVFLEELKDKMIGKQLNFGQLLYVVYEVLVKNKDLDKILSK<br>KIDYRKDKSFSPEIAYLRNFLSHLNYSKFLDNFMKINTNKSDEN<br>KEVLIPSIKIQKMIQFIEKCNLQNQIDFDFNFVNDFYMRKEKMFF<br>IQLKQIFPDINSTEKQKKSEKEEILRKRYHLINKKNEQIKDEHEA<br>QSQLYEKILSLQKIFSCDKNNFYRRLKEEKLLFLEKQGKKKISM<br>KEIKDKIASDISDLLGILKKEITRDIKDKLTEKFRYCEEKLLNISFY<br>NHQDKKKEEGIRVFLIRDKNSDNFKFESILDDGSNKIFISKNGKEI<br>TIQCCDKVLETLMIEKNTLKISSNGKIISLIPHYSYSIDVKY |
| *Fusobacterium necrophorum* subsp. *funduliforme* 1_1_36S cont1.14 (SEQ ID No. 229) | MTEKKSIIFKNKSSVEIVKKDIFSQTPDNMIRNYKITLKISEKNPR<br>VVEAEIEDLMNSTILKDGRRSARREKSMTERKLIEEKVAENYSL<br>LANCPMEEVDSIKIYKIKRFLTYRSNMLLYFASINSFLCEGIKGK<br>DNETEEIWHLKDNDVRKEKVKENFKNKLIQSTENYNSSLKNQIE<br>EKEKLLRKESKKGAFYRTIIKKLQQERIKELSEKSLTEDCEKIIKL<br>YSELRHPLMHYDYQYFENLFENKENSELTKNLNLDIFKSLPLVR<br>KMKLNNKVNYLEDNDTLFVLQKTKKAKTLYQIYDALCEQKNG<br>FNKFINDFFVSDGEENTVFKQIINEKFQSEMEFLEKRISESEKKNE<br>KLKKKFDSMKAHFHNINSEDTKEAYFWDIHSSSNYKTKYNERK<br>NLVNEYTELLGSSKEKKLLREEITQINRKLLKLKQEMEEITKKNS<br>LFRLEYKMKIAFGFLFCEFDGNISKFKDEFDASNQEKIIQYHKNG<br>EKYLTYFLKEEEKEKFNLEKMQKIIQKTEEEDWLLPETKNNLFK<br>FYLLTYLLLPYELKGDFLGFVKKHYYDIKNVDFMDENQNNIQV<br>SQTVEKQEDYFYHKIRLFEKNTKKYEIVKYSIVPNEKLKQYFED<br>LGIDIKYLTGSVESGEKWLGENLGIDIKYLTVEQKSEVSEEKIKK<br>FL |
| *Fusobacterium perfoetens* ATCC 29250 T364DRAFT_scaffold00009.9_C (SEQ ID No. 230) | MGKPNRSSIIKIIISNYDNKGIKEVKVRYNKQAQLDTFLIKSELK<br>DGKFILYSIVDKAREKYRYSFEIDKTNINKNEILIIKKDIYSNKED<br>KVIRKYILSFEVSEKNDRTIVTKIKDCLETQKKEKFERENTRRLIS<br>ETERKLLSEETQKTYSKIACCSPEDIDSVKIYKIKRYLAYRSNML<br>LFFSLINDIFVKGVVKDNGEEVGEIWRIIDSKEIDEKKTYDLLVE<br>NFKKRMSQEFINYKQSIENKIEKNTNKIKEIEQKLKKEKYKKEIN<br>RLKKQLIELNRENDLLEKDKIELSDEEIREDIEKILKIYSDLRHKL<br>MHYNYQYFENLFENKKISKEKNEDVNLTELLDLNLFRYLPLVR<br>QLKLENKTNYLEKEDKITVLGVSDSAIKYYSYYNFLCEQKNGF<br>NNFINSFFSNDGEENKSFKEKINLSLEKEIEIMEKETNEKIKEINK<br>NELQLMKEQKELGTAYVLDIHSLNDYKISHNERNKNVKLQNDI<br>MNGNRDKNALDKINKKLVELKIKMDKITKRNSILRLKYKLQVA<br>YGFLMEEYKGNIKKFKDEFDISKEKIKSYKSKGEKYLEVKSEKK<br>YITKILNSIEDIHNITWLKNQEENNLFKFYVLTYILLPFEFRGDFL<br>GFVKKHYYDIKNVEFLDENNDRLTPEQLEKMKNDSFFNKIRLFE<br>KNSKKYDILKESILTSERIGKYFSLLNTGAKYFEYGGEENRGIFN<br>KNIIIPIFKYYQIVLKLYNDVELAMLLTLSESDEKDINKIKELVTL<br>KEKVSPKKIDYEKKYKFSVLLDCFNRIINLGKKDFLASEEVKEV<br>AKTFTNLAYLRNKICHLNYSKFIDDLLTIDTNKSTTDSEGKLLIN<br>DRIRKLIKFIRENNQKMNISIDYNYINDYYMKKEKFIFGQRKQA |

TABLE 3-continued

| | |
|---|---|
| | KTIIDSGKKANKRNKAEELLKMYRVKKENINLIYELSKKLNELT<br>KSELFLLDKKLLKDIDFTDVKIKNKSFFELKNDVKEVANIKQAL<br>QKHSSELIGIYKKEVIMAIKRSIVSKLIYDEEKVLSIIIYDKTNKK<br>YEDFLLEIRRERDINKFQFLIDEKKEKLGYEKIIETKEKKKVVVKI<br>QNNSELVSEPRIIKNKDKKKAKTPEEISKLGILDLTNHYCFNLKI<br>TL |
| *Fusobacterium ulcerans* ATCC 49185 cont2.38 (SEQ ID No. 231) | MENKGNNKKIDFDENYNILVAQIKEYFTKEIENYNNRIDNIIDKK<br>ELLKYSEKKEESEKNKKLEELNKLKSQKLKILTDEEIKADVIKII<br>KIFSDLRHSLMHYEYKYFENLFENKKNEELAELLNLNLFKNLTL<br>LRQMKIENKTNYLEGREEFNIIGKNIKAKEVLGHYNLLAEQKNG<br>FNNFINSFFVQDGTENLEFKKLIDEHFVNAKKRLERNIKKSKKLE<br>KELEKMEQHYQRLNCAYVWDIHTSTTYKKLYNKRKSLIEEYN<br>KQINEIKDKEVITAINVELLRIKKEMEEITKSNSLFRLKYKMQIA<br>YAFLEIEFGGNIAKFKDEFDCSKMEEVQKYLKKGVKYLKYYKD<br>KEAQKNYEFPFEEIFENKDTHNEEWLENTSENNLFKFYILTYLLL<br>PMEFKGDFLGVVKKHYYDIKNVDFTDESEKELSQVQLDKMIGD<br>SFFHKIRLFEKNTKRYEIIKYSILTSDEIKRYFRLLELDVPYFEYE<br>KGTDEIGIFNKNIILTIFKYYQIIFRLYNDLEIHGLFNISSDLDKILR<br>DLKSYGNKNINFREFLYVIKQNNNSSTEEEYRKIWENLEAKYLR<br>LHLLTPEKEEIKTKTKEELEKLNEISNLRNGICHLNYKEIIEEILKT<br>EISEKNKEATLNEKIRKVINFIKENELDKVELGFNFINDFFMKKE<br>QFMFGQIKQVKEGNSDSITTERERKEKNNKKLKETYELNCDNL<br>SEFYETSNNLRERANSSSLLEDSAFLKKIGLYKVKNNKVNSKVK<br>DEEKRIENIKRKLLKDSSDIMGMYKAEVVKKLKEKLILIFKHDE<br>EKRIYVTVYDTSKAVPENISKEILVKRNNSKEEYFFEDNNKKYV<br>TEYYTLEITETNELKVIPAKKLEGKEFKTEKNKENKLMLNNHYC<br>FNVKIIY |
| *Anaerosalibacter* sp. ND1 genome assembly *Anaerosalibacter massiliensis* ND1 (SEQ ID No. 232) | MKSGRREKAKSNKSSIVRVIISNFDDKQVKEIKVLYTKQGGIDVI<br>KFKSTEKDEKGRMKFNFDCAYNRLEEEEFNSFGGKGKQSFFVT<br>TNEDLTELHVTKRHKTTGEIIKDYTIQGKYTPIKQDRTKVTVSIT<br>DNKDHFDSNDLGDKIRLSRSLTQYTNRILLDADVMKNYREIVCS<br>DSEKVDETINIDSQEIYKINRFLSYRSNMIIYYQMINNFLLHYDG<br>EEDKGGNDSINLINEIWKYENKKNDEKEKIIERSYKSIEKSINQYI<br>LNHNTEVESGDKEKKIDISEERIKEDLKKTFILFSRLRHYMVHYN<br>YKFYENLYSGKNFIIYNKDKSKSRRFSELLDLNIFKELSKIKLVK<br>NRAVSNYLDKKTTIHVLNKNINAIKLLDIYRDICETKNGFNNFIN<br>NMMTISGEEDKEYKEMVTKHFNENMNKLSIYLENFKKHSDFKT<br>NNKKKETYNLLKQELDEQKKLRLWFNAPYVYDIHSSKKYKEL<br>YVERKKYVDIHSKLIEAGINNDNKKKLNEINVKLCELNTEMKE<br>MTKLNSKYRLQYKLQLAFGFILEEFNLDIDKFVSAFDKDNNLTI<br>SKFMEKRETYLSKSLDRRDNRFKKLIKDYKFRDTEDIFCSDREN<br>NLVKLYILMYILLPVEIRGDFLGFVKKNYYDLKHVDFIDKRNND<br>NKDTFFHDLRLFEKNVKRLEVTSYSLSDGFLGKKSREKFGKELE<br>KFIYKNVSIALPTNIDIKEFNKSLVLPMMKNYQIIFKLLNDIEISA<br>LFLIAKKEGNEGSITFKKVIDKVRKEDMNGNINFSQVMKMALN<br>EKVNCQIRNSIAHINMKQLYIEPLNIYINNNQNKKTISEQMEEIID<br>ICITKGLTGKELNKNIINDYYMKKEKLVFNLKLRKRNNLVSIDA<br>QQKNMKEKSILNKYDLNYKDENLNIKEIILKVNDLNNKQKLLK<br>ETTEGESNYKNALSKDILLLNGIIRKNINFKIKEMILGIIQQNEYR<br>YVNINIYDKIRKEDHNIDLKINNKYIEISCYENKSNESTDERINFK<br>IKYMDLKVKNELLVPSCYEDIYIKKKIDLEIRYIENCKVVYIDIY<br>YKKYNINLEFDGKTLFVKFNKDVKKNNQKVNLESNYIQNIKFIV<br>S |

TABLE 4

| Name | Sequence |
|---|---|
| EH019081 | MTEKKSIIFKNKSSVEIVKKDIFSQTPDNMIRNYKITLKISEKNPRVVEAEIEDLMNSTILKDG<br>RRSARREKSMTERKLIEEKVAENYSLLANCPMEEVDSIKIYKIKRFLTYRSNMLLYFASINSFL<br>CEGIKGKDNETEEIWHLKDNDVRKEKVKENFKNKLIQSTENYNSSLKNQIEEKEKLLRKESK<br>KGAFYRTIIKKLQQERIKELSEKSLTEDCEKIIKLYSELRHPLMHYDYQYFENLFENKENSELTK<br>NLNLDIFKSLPLVRKMKLNNKVNYLEDNDTLFVLQKTKKAKTLYQIYDALCEQKNGFNKFI<br>NDFFVSDGEENTVFKQIINEKFQSEMEFLEKRISESEKKNEKLKKKFDSMKAHFHNINSEDT<br>KEAYFWDIHSSSNYKTKYNERKNLVNEYTELLGSSKEKKLLREEITQINRKLLKLKQEMEEIT<br>KKNSLFRLEYKMKIAFGFLFCEFDGNISKFKDEFDASNQEKIIQYHKNGEKYLTYFLKEEEKE<br>KFNLEKMQKIIQKTEEEDWLLPETKNNLFKFYLLTYLLLPYELKGDFLGFVKKHYYDIKNVDF<br>MDENQNNIQVSQTVEKQEDYFYHKIRLFEKNTKKYEIVKYSIVPNEKLKQYFEDLGIDIKYLT<br>GSVESGEKWLGENLGIDIKYLTVEQKSEVSEEKIKKFL |
| WP_094899336 | MEKDKKGEKIDISQEMIEEDLRKILILFSRLRHSMVHYDYEFYQALYSGKDFVISDKNNLEN<br>RMISQLLDLNIFKELSKVKLIKDKAISNYLDKNTTIHVLGQDIKAIRLLDIYRDICGSKNGFNKF<br>INTMITISGEEDREYKEKVIEHFNKKMENLSTYLEKLEKQDNAKRNNKRVYNLLKQKLIEQQ<br>KLKEWFGGPYVYDIHSSKRYKELYIERKKLVDRHSKLFEEGLDEKNKKELTKINDELSKLNSE<br>MKEMTKLNSKYRLQYKLQLAFGFILEEFDLNIDTFINNFDKDKDLIISNFMKKRDIYLNRVL |

TABLE 4-continued

| Name | Sequence |
|---|---|
| | DRGDNRLKNIIKEYKFRDTEDIFCNDRDNNLVKLYILMYILLPVEIRGDFLGFVKKNYYDMK<br>HVDFIDKKDKEDKDTFFHDLRLFEKNIRKLEITDYSLSSGFLSKEHKVDIEKKINDFINRNGA<br>MKLPEDITIEEFNKSLILPIMKNYQINFKLLNDIEISALFKIAKDRSITFKQAIDEIKNEDIKKNS<br>KKNDKNNHKDKNINFTQLMKRALHEKIPYKAGMYQIRNNISHIDMEQLYIDPLNSYMNS<br>NKNNITISEQIEKIIDVCVTGGVTGKELNNNIINDYYMKKEKLVFNLKLRKQNDIVSIESQEK<br>NKREEFVFKKYGLDYKDGEINIIEVIQKVNSLQEELRNIKETSKEKLKNKETLFRDISLINGTIR<br>KNINFKIKEMVLDIVRMDEIRHINIHIYYKGENYTRSNIIKFKYAIDGENKKYYLKQHEINDIN<br>LELKDKFVTLICNMDKHPNKNKQTINLESNYIQNVKFIIP |
| WP_040490876 | MENKGNNKKIDFDENYNILVAQIKEYFTKEIENYNNRIDNIIDKKELLKYSEKKEESEKNKKL<br>EELNKLKSQKLKILTDEEIKADVIKIIKIFSDLRHSLMHYEYKYFENLFENKKNEELAELLNLNL<br>FKNLTLLRQMKIENKTNYLEGREEFNIIGKNIKAKEVLGHYNLLAEQKNGFNNFINSFFVQD<br>GTENLEFKKLIDEHFVNAKKRLERNIKKSKKLEKELEKMEQHYQRLNCAYVWDIHTSTTYK<br>KLYNKRKSLIEEYNKQINEIKDKEVITAINVELLRIKKEMEEITKSNSLFRLKYKMQIAYAFLEIE<br>FGGNIAKFKDEFDCSKMEEVQKYLKKGVKYLKYYKDKEAQKNYEFPFEEIFENKDTHNEE<br>WLENTSENNLFKFYILTYLLLPMEFKGDFLGVVKKHYYDIKNVDFTDESEKELSQVQLDKMI<br>GDSFFHKIRLFEKNTKRYEIIKYSILTSDEIKRYFRLLELDVPYFEYEKGTDEIGIFNKNIILTIFKY<br>YQIIFRLYNDLEIHGLFNISSDLDKILRDLKSYGNKNINFREFLYVIKQNNNSSTEEEYRKIWE<br>NLEAKYLRLHLLTPEKEEIKTKTKEELEKLNEISNLRNGICHLNYKEIIEEILKTEISEKNKEATLN<br>EKIRKVINFIKENELDKVELGFNFINDFFMKKEQFMFGQIKQVKEGNSDSITTERERKEKNN<br>KKLKETYELNCDNLSEFYETSNNLRERANSSSLLEDSAFLKKIGLYKVKNNKVNSKVKDEEKR<br>IENIKRKLLKDSSDIMGMYKAEVVKKLKEKLILIFKHDEEKRIYVTVYDTSKAVPENISKEILVK<br>RNNSKEEYFFEDNNKKYVTEYYTLEITETNELKVIPAKKLEGKEFKTEKNKENKLMLNNHYC<br>FNVKIIY |
| WP_047396607 | MEEIKHKKNKSSIIRVIVSNYDMTGIKEIKVLYQKQGGVDTFNLKTIINLESGNLEIISCKPKE<br>REKYRYEFNCKTEINTISITKKDKVLKKEIRKYSLELYFKNEKKDTVVAKVTDLLKAPDKIEGER<br>NHLRKLSSSTERKLLSKTLCKNYSEISKTPIEEIDSIKIYKIKRFLNYRSNFLIYFALINDFLCAGV<br>KEDDINEVWLIQDKEHTAFLENRIEKITDYIFDKLSKDIENKKNQFEKRIKKYKTSLEELKTET<br>LEKNKTFYIDSIKTKITNLENKITELSLYNSKESLKEDLIKIISIFTNLRHSLMHYDYKSFENLFEN<br>IENEELKNLLDLNLFKSIRMSDEFKTKNRTNYLDGTESFTIVKKHQNLKKLYTYYNNLCDKK<br>NGFNTFINSFFVTDGIENTDFKNLIILHFEKEMEEYKKSIEYYKIKISNEKNKSKKEKLKEKIDLL<br>QSELINMREHKNLLKQIYFFDIHNSIKYKELYSERKNLIEQYNLQINGVKDVTAINHINTKLLS<br>LKNKMDKITKQNSLYRLKYKLKIAYSFLMIEFDGDVSKFKNNFDPTNLEKRVEYLDKKEEYL<br>NYTAPKNKFNFAKLEEELQKIQSTSEMGADYLNVSPENNLFKFYILTYIMLPVEFKGDFLGF<br>VKNHYYNIKNVDFMDESLLDENEVDSNKLNEKIENLKDSSFFNKIRLFEKNIKKYEIVKYSVS<br>TQENMKEYFKQLNLDIPYLDYKSTDEIGIFNKNMILPIFKYYQNVFKLCNDIEIHALLALANK<br>KQQNLEYAIYCCSKKNSLNYNELLKTFNRKTYQNLSFIRNKIAHLNYKELFSDLFNNELDLNT<br>KVRCLIEFSQNNKFDQIDLGMNFINDYYMKKTRFIFNQRRLRDLNVPSKEKIIDGKRKQQN<br>DSNNELLKKYGLSRTNIKDIFNKAWY |
| WP_035935671 | MKVRYRKQAQLDTFIIKTEIVNNDIFIKSIIEKAREKYRYSFLFDGEEKYHFKNKSSVEIVKNDI<br>FSQTPDNMIRNYKITLKISEKNPRVVEAEIEDLMNSTILKDGRRSARREKSMTERKLIEEKV<br>AENYSLLANCPIEEVDSIKIYKIKRFLTYRSNMLLYFASINSFLCEGIKGKDNETEEIWHLKDN<br>DVRKEKVKENFKNKLIQSTENYNSSLKNQIEEKEKLSSKEFKKGAFYRTIIKKLQQERIKELSE<br>KSLTEDCEKIIKLYSELRHPLMHYDYQYFENLFENKENSELTKNLNLDIFKSLPLVRKMKLNN<br>KVNYLEDNDTLFVLQKTKKAKTLYQIYDALCEQKNGFNKFINDFFVSDGEENTVFKQIINEK<br>FQSEMEFLEKRISESEKKNEKLKKKLDSMKAHFRNINSEDTKEAYFWDIHSSRNYKTKYNE<br>RKNLVNEYTKLLGSSKEKKLLREEITKINRQLLKLKQEMEEITKKNSLFRLEYKMKIAFGFLFC<br>EFDGNISKFKDEFDASNQEKIIQYHKNGEKYLTSFLKEEEKEKFNLEKMQKIIQKTEEEDWL<br>LPETKNNLFKFYLLTYLLLPYELKGDFLGFVKKHYYDIKNVDFMDENQNNIQVSQTVEKQE<br>DYFYHKIRLFEKNTKKYEIVKYSIVPNEKLKQYFEDLGIDIKYLTGSVESGEKWLGENLGIDIK<br>YLTVEQKSEVSEEKNKKVSLKNNGMFNKTILLFVFKYYQIAFKLFNDIELYSLFFLREKSEKPF<br>EVFLEELKDKMIGKQLNFGQLLYVVYEVLVKNKDLDKILSKKIDYRKDKSFSPEIAYLRNFLS<br>HLNYSKFLDNFMKINTNKSDENKEVLIPSIKIQKMIQFIEKCNLQNQIDFDFNFVNDFYMR<br>KEKMFFIQLKQIFPDINSTEKQKKSEKEEILRKRYHLINKKNEQIKDEHEAQSQLYEKILSLQK<br>IFSCDKNNFYRRLKEEKLLFLEKQGKKKISMKEIKDKIASDISDLLGILKKEITRDIKDKLTEKFR<br>YCEEKLLNISFYNHQDKKKEEGIRVFLIRDKNSDNFKFESILDDGSNKIFISKNGKEITIQCCD<br>KVLETLMIEKNTLKISSNGKIISLIPHYSYSIDVKY |
| WP_035906563 | MEKFRRQNRSSIIKIIISNYDTKGIKELKVRYRKQAQLDTFIIKTEIVNNDIFIKSIIEKAREKYRY<br>SFLFDGEEKYHFKNKSSVEIVKKDIFSQTPDNMIRNYKITLKISEKNPRVVEAEIEDLMNSTIL<br>KDGRRSARREKSMTERKLIEEKVAENYSLLANCPMEEVDSIKIYKIKRFLTYRSNMLLYFASI<br>NSFLCEGIKGKDNETEEIWHLKDNDVRKEKVKENFKNKLIQSTENYNSSLKNQIEEKEKLLR<br>KESKKGAFYRTIIKKLQQERIKELSEKSLTEDCEKIIKLYSELRHPLMHYDYQYFENLFENKEN<br>SELTKNLNLDIFKSLPLVRKMKLNNKVNYLEDNDTLFVLQKTKKAKTLYQIYDALCEQKNGF<br>NKFINDFFVSDGEENTVFKQIINEKFQSEIEFLEKRISESEKKNEKLKKKLDSMKAHFRNINSE<br>DTKEAYFWDIHSSRNYKTKYNERKNLVNEYTELLGSSKEKKLLREEITKINRQLLKLKQEME<br>EITKKNSLFRLEYKMKMAFGFLFCEFDGNISRFKDEFDASNQEKIIQYHKNGEKYLTYFLKEE<br>EKEKFNLKKLQETIQKTGEENWLLPQNKNNLFKFYLLTYLLLPYELKGDFLGFVKKHYYDIK<br>NVDFMDENQSSKIIESKEDDFYHKIRLFEKNTKKYEIVKYSIVPDKKLKQYFKDLGIDTKYLIL<br>DQKSEVSGEKNKKVSLKNNGMFNKTILLFVFKYYQIAFKLFNDIELYSLFFLREKSGKPFEVF<br>LKELKDKMIGKQLNFGQLLYVVYEVLVKNKDLSEILSERIDYRKDMCFSAEIADLRNFLSHN<br>YSKFLDNFMKINTNKSDENKEVLIPSIKIQKMIKFIEECNLQSQIDFDFNFVNDFYMRKEKM<br>FFIQLKQIFPDINSTEKQKMNEKEEILRNRYHLTDKKNEQIKDEHEAQSQLYEKILSLQKIYSS<br>DKNNFYGRLKEEKLLFLEKQEKKKLSMEEIKDKIAGDISDLLGILKKEITRDIKDKLTEKFRYCE<br>EKLLNLSFYNHQDKKKEESIRVFLIRDKNSDNFKFESILDDGSNKIFISKNGKEITIQCCDKVL<br>ETLIIEKNTLKISSNGKIISLIPHYSYSIDVKY |

TABLE 4-continued

| Name | Sequence |
| --- | --- |
| WP_042678931 | MKSGRREKAKSNKSSIVRVIISNFDDKQVKEIKVLYTKQGGIDVIKFKSTEKDEKGRMKFNF<br>DCAYNRLEEEEFNSFGGKGKQSFFVTTNEDLTELHVTKRHKTTGEIIKDYTIQGKYTPIKQD<br>RTKVTVSITDNKDHFDSNDLGDKIRLSRSLTQYTNRILLDADVMKNYREIVCSDSEKVDETI<br>NIDSQEIYKINRFLSYRSNMIIYYQMINNFLLHYDGEEDKGGNDSINLINEIWKYENKKNDE<br>KEKIIERSYKSIEKSINQYILNHNTEVESGDKEKKIDISEERIKEDLKKTFILFSRLRHYMVHYNY<br>KFYENLYSGKNFIIYNKDKSKSRRFSELLDLNIFKELSKIKLVKNRAVSNYLDKKTTIHVLNKNI<br>NAIKLLDIYRDICETKNGFNNFINNMMTISGEEDKEYKEMVTKHFNENMNKLSIYLENFKK<br>HSDFKTNNKKKETYNLLKQELDEQKKLRLWFNAPYVYDIHSSKKYKELYVERKKYVDIHSKL<br>IEAGINNDNKKKLNEINVKLCELNTEMKEMTKLNSKYRLQYKLQLAFGFILEEFNLDIDKFV<br>SAFDKDNNLTISKFMEKRETYLSKSLDRRDNRFKKLIKDYKFRDTEDIFCSDRENNLVKLYIL<br>MYILLPVEIRGDFLGFVKKNYYDLKHVDFIDKRNNDNKDTFFHDLRLFEKNVKRLEVTSYSL<br>SDGFLGKKSREKFGKELEKFIYKNVSIALPTNIDIKEFNKSLVLPMMKNYQIIFKLLNDIEISAL<br>FLIAKKEGNEGSITFKKVIDKVRKEDMNGNINFSQVMKMALNEKVNCQIRNSIAHINMKQ<br>LYIEPLNIYINNNQNKKTISEQMEEIIDICITKGLTGKELNKNIINDYYMKKEKLVFNLKLRKR<br>NNLVSIDAQQKNMKEKSILNKYDLNYKDENLNIKEIILKVNDLNNKQKLLKETTEGESNYK<br>NALSKDILLLNGIIRKNINFKIKEMILGIIQQNEYRYVNINIYDKIRKEDHNIDLKINNKYIEISC<br>YENKSNESTDERINFKIKYMDLKVKNELLVPSCYEDIYIKKKIDLEIRYIENCKVVYIDIYYKKY<br>NINLEFDGKTLFVKFNKDVKKNNQKVNLESNYIQNIKFIVS |
| WP_062627846 | MEKFRRQNRNSIIKIIISNYDTKGIKELKVRYRKQAQLDTFIIKTEIVNNDIFIKSIIEKAREKYR<br>YSFLFDGEEKYHFKNKSSVEIVKKDIFSQTPDNMIRNYKITLKISEKNPRVVEAEIEDLMNSTI<br>LKDGRRSARREKSVTERKLIEEKVAENYSLLANCPMEEVDSIKIYKIKRFLTYRSNMLLYFASI<br>NSFLCEGIKGKENETEEIWHLKDNDVRKEKVKENFKNKLIQSTENYNSSLKNQIEEKEKLLR<br>KESKKGAFYRTIIKKLQQERIKELSEKSLTEDCEKIIKLYSKLRHSLMHYDYQYFENLFENKETP<br>ELKDKLDLHLFKSLPLIRKMKLNNKVNYLEDGDTLFVLQKTKKAKTLYQIYDALCEQKNGFN<br>KFINDFFVSDGEENTVFKQIINEKFQSEMEFLGKRISESEEKNPKLKKKFDSMKAHFHNINS<br>EDTKEAYFWDIHSSSNYKTKYNERKNLVNEYTELLGSSKEKKLLREEITQINRKLLKLKQEME<br>EITKKNSLFRLEYKMKMAFGFLFCEFDGNISRFKDEFDASNQEKIIQYHKNGEKYLTYFLKEE<br>EKEKFNLKKLQETIQKTGKENWLLPQNKNNLFKFYLLTYLLLPYELKGDFLGFVKKHYYDIK<br>NVDFMDENQSSKIIESKEDDFYHKIRLFEKNTKKYEIVKYSIVPDEKLKQYFKDLGIDTKYLIL<br>EQKSEVSGEKNKKVSLKNNGMFNKTILLFVFKYYQIAFKLFNDIELYSLFFLREKSGKPFEVFL<br>KELKDKMIGKQLNFGQLLYVIYEVLVKNKDLSEILSERIDYRKDMCFSAEIADLRNFLSHLNY<br>SKFLDNFMKINTNKSDENKEVLIPSIKIQKMIKFIEECNLQSQIDFDFNFVNDFYMRKEKMF<br>FIQLKQIFPDINSTEKQKMNEKEEILRNRYHLTDKKNEQIKDEHEAQSQLYEKILSLQKIYSS<br>DKNNFYGRLKEEKLLFLGKQGKKKLSMEEIKDKIAGDISDLLGILKKEITRDIKDKLTEKFRYC<br>EEKLLNLSFYNHQDKKKEESIRVFLIRDKNSDNFKFESILDDGSNKIFISKNGKEITIQCCDKV<br>LETLMIEKNTLKISSNGKIISLVPHYSYSIDVKY |
| WP_005959231 | MEKFRRQNRNSIIKIIISNYDTKGIKELKVRYRKQAQLDTFIIKTEIVNNDIFIKSIIEKAREKYR<br>YSFLFDGEEKYHFKNKSSVEIVKKDIFSQTPDNMIRNYKITLKISEKNPRVVEAEIEDLMNSTI<br>LKDGRRSARREKSMTERKLIEEKVAKNYSLLANCPMEEVDSIKIYKIKRFLTYRSNMLLYFAS<br>INSFLCEGIKGKDNETEEIWHLKDNDVRKEKVRENFKNKLIQSTENYNSSLKNQIEEKEKLL<br>RKEFKKGAFYRTIIKKLQQERIKELSEKSLTEDCEKIIKLYSKLRHSLMHYDYQYFENLFENKK<br>NDDLMKDLNLDLFKSLPLIRKMKLNNKVNYLEDGDTLFVLQKTKKAKTLYQIYDALCEQKN<br>GFNKFINDFFVSDGEENTVFKQIINEKFQSEMEFLEKRISESEKKNEKLKKKLDSMKAHFRN<br>INSEDTKEAYFWDIHSSRNYKTKYNERKNLVNEYTELLGSSKEKKLLREEITKINRQLLKLKQ<br>EMEEITKKNSLFRLEYKMKIAFGFLFCEFDGNISKFKDEFDASNQEKIIQYHKNGEKYLTSFL<br>KEEEKEKFNLEKMQKIIQKTEEEDWLLPETKNNLFKFYLLTYLLLPYELKGDFLGFVKKHYYD<br>IKNVDFIDENQNNIQVSQTVEKQEDYFYHKIRLFEKNTKKYEIVKYSIVPNEKLKQYFEDLGI<br>DIKYLTVEQKSEVSEEKNKKVSLKNNGMFNKTILLFVFKYYQIAFKLFNDIELYSLFFLREKSG<br>KPLEIFRKELESKMKDGYLNFGQLLYVVYEVLVKNKDLDKILSKKIDYRKDKSFSPEIAYLRNF<br>LSHLNYSKFLDNFMKINTNKSDENKEVLIPSIKIQKMIQFIEKCNLQNQIDFDFNFVNDFYM<br>RKEKMFFIQLKQIFPDINSTEKQKMNEKEEILRNRYHLTDKKNEQIKDEHEAQSQLYEKILS<br>LQKIYSSDKNNFYGRLKEEKLLFLEKQGKKKLSMEEIKDKIAGDISDLLGILKKEITRDIKDKLT<br>EKFRYCEEKLLNLSFYNHQDKKKEESIRVFLIRDKNSDNFKFESILDDGSNKIFISKNGKEITIQ<br>CCDKVLETLIIEKNTLKISSNGKIISLIPHYSYSIDVKY |
| WP_027128616 | MGKPNRSSIIKIIISNYDNKGIKEVKVRYNKQAQLDTFLIKSELKDGKFILYSIVDKAREKYRYS<br>FEIDKTNINKNEILIIKKDIYSNKEDKVIRKYILSFEVSEKNDRTIVTKIKDCLETQKKEKFEREN<br>TRRLISETERKLLSEETQKTYSKIACCSPEDIDSVKIYKIKRYLAYRSNMLLFFSLINDIFVKGVV<br>KDNGEEVGEIWRIIDSKEIDEKKTYDLLVENFKKRMSQEFINYKQSIENKIEKNTNKIKEIEQ<br>KLKKEKYKKEINRLKKQLIELNRENDLLEKDKIELSDEEIREDIEKILKIYSDLRHKLMHYNYQY<br>FENLFENKKISKEKNEDVNLTELLDLNLFRYLPLVRQLKLENKTNYLEKEDKITVLGVSDSAIK<br>YYSYYNFLCEQKNGFNNFINSFFSNDGEENKSFKEKINLSLEKEIEIMEKETNEKIKEINKNEL<br>QLMKEQKELGTAYVLDIHSLNDYKISHNERNKNVKLQNDIMNGNRDKNALDKINKKLVEL<br>KIKMDKITKRNSILRLKYKLQVAYGFLMEEYKGNIKKFKDEFDISKEKIKSYKSKGEKYLEVKS<br>EKKYITKILNSIEDIHNITWLKNQEENNLFKFYVLTYILLPFEFRGDFLGFVKKHYYDIKNVEFL<br>DENNDRLTPEQLEKMKNDSFFNKIRLFEKNSKKYDILKESILTSERIGKYFSLLNTGAKYFEY<br>GGEENRGIFNKNIIIPIFKYYQIVLKLYNDVELAMLLTLSESDEKDINKIKELVTLKEKVSPKKI<br>DYEKKYKFSVLLDCFNRIINLGKKDFLASEEVKEVAKTFTNLAYLRNKICHLNYSKFIDDLLTI<br>DTNKSTTDSEGKLLINDRIRKLIKFIRENNQKMNISIDYNYINDYYMKKEKFIFGQRKQAKTII<br>DSGKKANKRNKAEELLKMYRVKKENINLIYELSKKLNELTKSELFLLDKKLLKDIDFTDVKIKN<br>KSFFELKNDVKEVANIKQALQKHSSELIGIYKKEVIMAIKRSIVSKLIYDEEKVLSIIIYDKTNKK<br>YEDFLLEIRRERDINKFQFLIDEKKEKLGYEKIIETKEKKKVVVKIQNNSELVSEPRIIKNKDKK<br>KAKTPEEISKLGILDLTNHYCFNLKITL |

TABLE 4-continued

| Name | Sequence |
|---|---|
| WP_062624740 | MEKFRRQNRNSIIKIIISNYDTKGIKELKVRYRKQAQLDTFIIKTEIVNNDIFIKSIIEKAREKYR<br>YSFLFDGEEKYHFKNKSSVEIVKKDIFSQTPDNMIRNYKITLKISEKNPRVVEAEIEDLMNSTI<br>LKDGRRSARREKSMTERKLIEEKVAKNYSLLANCPMEEVDSIKIYKIKRFLTYRSNMLLYFAS<br>INSFLCEGIKGKDNETEEIWHLKDNDVRKEKVRENFKNKLIQSTENYNSSLKNQIEEKEKLL<br>RKEFKKGAFYRTIIKKLQQERIKELSEKSLTEDCEKIIKLYSKLRHSLMHYDYQYFENLFENKK<br>NDDLMKDLNLDLFKSLPLIRKMKLNNKVNYLEDGDTLFVLQKTKKAKTLYQIYDALCEQKN<br>GFNKFINDFFVSDGEENTVFKQIINEKFQSEMEFLEKRISESEKKNEKLKKKLDSMKAHFRN<br>INSEDTKEAYFWDIHSSRNYKTKYNERKNLVNEYTELLGSSKEKKLLREEITKINRQLLKLKQ<br>EMEEITKKNSLFRLEYKMKIAFGFLFCEFDGNISKFKDEFDASNQEKIIQYHKNGEKYLTSFL<br>KEEEKEKFNLEKMQKIIQKTEEEDWLLPETKNNLFKFYLLTYLLLPYELKGDFLGFVKKHYYD<br>IKNVDFIDENQNNIQVSQTVEKQEDYFYHKIRLFEKNTKKYEIVKYSIVPNEKLKQYFEDLGI<br>DIKYLTGSVESGEKWLGENLGIDIKYLTVEQKSEVSEEKNKKVSLKNNGMFNKTILLFVFKY<br>YQIAFKLFNDIELYSLFFLREKSGKPLEIFRKELESKMKDGYLNFGOLLYVVYEVLVKNKDLD<br>KILSKKIDYRKDKSFSPEIAYLRNFLSHLNYSKFLDNFMKINTNKSDENKEVLIPSIKIQKMIQF<br>IEKCNLQNQIDFDFNFVNDFYMRKEKMFFIQLKQIFPDINSTEKQKMNEKEEILRNRYHLT<br>DKKNEQIKDEHEAQSQLYEKILSLQKIYSSDKNNFYGRLKEEKLLFLEKQGKKKLSMEEIKDK<br>IAGDISDLLGILKKEITRDIKDKLTEKFRYCEEKLLNLSFYNHQDKKKEESIRVFLIRDKNSDNF<br>KFESILDDGSNKIFISKNGKEITIQCCDKVLETLIIEKNTLKISSNGKIISLIPHYSYSIDVKY |
| WP_096402050 | MENKNKPNRGSIVRIIISNYDMKGIKELKVRYRKQAQLDTFILQTTLDKSNNSILINDFRVK<br>AREKYRYSFTYDGKEKFSVPSNSIIVTKIDNAAPEKSKEIRKYKITLGIDEKCKTGSMITAAIED<br>LLEDDRVREGIRNPRRKASKTERKLITESICHNYAQITQCPVEEIDAVKIYKVKRFLSYRSNM<br>LLFFALINDFLCKNLKNEKGEKINEIWEMENKGNNKKIDFDENYNILVAQIKEYFTKEIENY<br>NNRIDNIIDKKELLKYSEEKEESEKNKKLEELNKLESQKLKILTDEEIKADVIKIIKIFSDLRHSL<br>MHYEYKYFENLFENKKNEELAELLNLNLFKNLTLLRQMKIENKTNYLEGDEKFNILGKDVR<br>AKNALGHYDLLVEQKNGFNNFINSFFVQDGTENLEFKKFIDENFIKAQKELEEDIKNCKESV<br>KKLEKKLKENPKKSEDLEKKLEKKQKKLKELKKELEKMKQHYKRLNCAYVWDIHSSTVYKKL<br>YNERKNLIEKYNKQLNGLQDKNAITGINAQLLRIKKEMEEITKSNSLFRLKYKMQIAYAFLE<br>MEYEGNIAKFKNEFDCSKTEKIQEWLEKSEEYLNYCMEKEEDGKNYKFHFKEISEIKDTHN<br>EEWLENTSENNLFKFYILTYLLLPMEFKGDFLGVVKKHYYDIKNVDFTDESEKELSQEQIDK<br>MIGDSFFHKIRLFEKNTKRYEIIKYSILTSDEIKKYFELLELKVPYLEYKGIDEIGIFNKNIILPIFKY<br>YQIIFRLYNDLEIHGLFNVSFDINKILSDLKSYGNENINFREFLYVIKQNNNSSTEEEYQKIWE<br>KLESKYLKEPLLTPEKKEINKKTEKELKKLDGISFLRNKISHLEYEKIIEGVLKTAVNGENKKTSE<br>TNADKVFLNEKIKKIINFIKENELDKIELGFNFINDFFMKKEQFMFGQIKQVKEGNSDSITTE<br>RKRKEENNKRLKITYGLNYNNLSKIYEFSNTLREIVNSPLFLKDSTLLKKVDLSKVMLKEKPIC<br>SLQYENNTKLEDDIKRILLKDSSDIMGIYKAEVVKKLKEKLVLIFKYDEEKKIYVTVYDTSKAV<br>PENISKEILVKRNNSKEEYFFEDNKKKYTTQYYTLEITKENELKVIPAKKLEGKEFKTEKKEEN<br>KLMLNNHYCFNVKIIY |

In certain example embodiments, the CRISPR effector protein is a Cas13d protein selected from Table 5.

TABLE 5

| | |
|---|---|
| RfxCas13d (SEQ ID NO: 233) | MIEKKKSFAKGMGVKSTLVSGSKVYMTTFAEGSDARLEKIVEGDSIRS<br>VNEGEAFSAEMADKNAGYKIGNAKFSHPKGYAVVANNPLYTGPVQQ<br>DMLGLKETLEKRYFGESADGNDNICIQVIHNILDIEKILAEYITNAAYA<br>VNNISGLDKDIIGFGKFSTVYTYDEFKDPEHHRAAFNNNDKLINAIKA<br>QYDEFDNFLDNPRLGYFGQAFFSKEGRNYIINYGNECYDILALLSGLR<br>HWVVHNNEEESRISRTWLYNLDKNLDNEYISTLNYLYDRITNELTNSF<br>SKNSAANVNYIAETLGINPAEFAEQYFRFSIMKEQKNLGFNITKLREV<br>MLDRKDMSEIRKNHKVFDSIRTKVYTMMDFVIYRYYIEEDAKVAAA<br>NKSLPDNEKSLSEKDIFVINLRGSFNDDQKDALYYDEANRIWRKLENI<br>MHNIKEFRGNKTREYKKKDAPRLPRILPAGRDVSAFSKLMYALTMFL<br>DGKEINDLLTTLINKFDNIQSFLKVMPLIGVNAKFVEEYAFFKDSAKIA<br>DELRLIKSFARMGEPIADARRAMYIDAIRILGTNLSYDELKALADTFSL<br>DENGNKLKKGKHGMRNFIINNVISNKRFHYLIRYGDPAHLHEIAKNEA<br>VVKFVLGRIADIQKKQGQNGKNQIDRYYETCIGKDKGKSVSEKVDAL<br>TKIITGMNYDQFDKKRSVIEDTGRENAEREKFKKIISLYLTVIYHILKNI<br>VNINARYVIGFHCVERDAQLYKEKGYDINLKKLEEKGFSSVTKLCAGI<br>DETAPDKRKDVEKEMAERAKESIDSLESANPKLYANYIKYSDEKKAE<br>EFTRQINREKAKTALNAYLRNTKWNVIIREDLLRIDNKTCTLFRNKAV<br>HLEVARYVHAYINDIAEVNSYFQLYHYIMQRIIMNERYEKSSGKVSEY<br>FDAVNDEKKYNDRLLKLLCVPFGYCIPRFKNLSIEALFDRNEAAKFDK<br>EKKKVSGNS |
| AdmCas13d (SEQ ID NO: 234) | MNNKRKTKAKAAGLKSVFFDQKQAVLTTFAKGNNSQIEKKVVNSEV<br>KDLRQPPAFDLELKEKTFYISGKNNINTSRENPLASASLPLSKRQRIRA<br>ERIKRAREENRPYHNVKRVGEDDLRAKADLEKHYFGKEYSDNLKIQII<br>YNILDINKIISPYINDIVYSMNNLARNDEYIDGKIDVIGSLSSTTDYSSFM<br>SPNKDLEKEKKFSFHRENYKKFVEASKPYMRYYGKVFIRDVKKSKLS<br>TGKGEKIEVMYRSDEEIFTIFQILSYVRQSIMHNDIGNKSSILAIEKYPA<br>RFVGFLSDLLKTKTNDVNRMFIDNNSQTNFWVLFSIFGLQDHTSGAD<br>KICRNFYDFVIKADSKNLGFSLKKIRELMLDLPNANMLRDHQFDTVRS |

TABLE 5-continued

| | |
|---|---|
| | KFYTLLDFIIYQHYLEEKSRIDNMVEKLRMTLKEEEKEVLYAAEAKIV<br>WNAIGAKVINKLVPMMNGDALKEIKRKNRDRKLPQSVIATVQVNSD<br>ANVFSGLIYFLTLFLDGKEINEMVSNLITKFENIDSLLHVDREIYKSDEK<br>DLDLEIEKLALFFKGVVRPNAKTDTGAGEISKSFSIFQSAERIIEELKFIK<br>NVTRMDNEIFPSEGVFLDAANVLGVRGDDFDFSNEFVGDDLHSDANK<br>KIINKINGTKEDRNLRNFIINNVVKSRRFQYIAREININTHYVKQLANNE<br>TLNRFVLNKMGDAKIINRYYESISGNTPNIEVRSQIDYLVKRLRSFSFE<br>DLNDVKQKVRPGTNESIEKEKKKALVGLCLTIQYLVYKNLVNINARY<br>TTAFYCLERDSKLKGFGVDVWRDFESYTALTNHFIKEGYLPVRKAEIL<br>RANLKHLDCEDGFKYYRNQVTHLNAIRVAYKYINEIKSVHSYFALYH<br>YIMQRHLYDSLQAKAKDSSGFVIDALKKSFEHKIYSKDLLHVLHSPFG<br>YNTARYKNLSIEALFDKNESRPEVNPLSTND |
| UrCas13d (SEQ ID NO: 235) | MAKKNKMKPRELREAQKKARQLKAAEINNNAAPAIAAMPAAEVIAP<br>AAEKKKSSVKAAGMKSILVSENKMYITSFGKGNSAVLEYEVDNNDY<br>NQTQLSSKDNSNIQLGGVNEVNITFSSKHGFESGVEINTSNPTHRSGES<br>SPVRGDMLGLKSELEKRFFGKTFDDNIHIQLIYNILDIEKILAVYVTNIV<br>YALNNMLGVKGSESHDDFIGYLSTNNIYDVFIDPDNSSLSDDKKANVR<br>KSLSKFNALLKTKRLGYFGLEEPKTKDNRVSQAYKKRVYHMLAIVGQ<br>IRQCVFHDKSGAKRFDLYSFINNIDPEYRDTLDYLVEERLKSINKDFIE<br>DNKVNISLLIDMMKGYEADDIIRLYYDFIVLKSQKNLGFSIKKLREKM<br>LDEYGFRFKDKQYDSVRSKMYKLMDFLLFCNYYRNDIAAGESLVRK<br>LRFSMTDDEKEGIYADEAAKLWGKFRNDFENIADHMNGDVIKELGK<br>ADMDFDEKILDSEKKNASDLLYFSKMIYMLTYFLDGKEINDLLTTLIS<br>KFDNIKEFLKIMKSSAVDVECELTAGYKLFNDSQRITNELFIVKNIASM<br>RKPAASAKLTMFRDALTILGIDDKITDDRISGILKLKEKGKGIHGLRNFI<br>TNNVIESSRFVYLIKYANAQKIREVAKNEKVVMFVLGGIPDTQIERYY<br>KSCVEFPDMNSSLGVKRSELARMIKNISFDDFKNVKQQAKGRENVAK<br>ERAKAVIGLYLTVMYLLVKNLVNVNARYVIAIHCLERDFGLYKEIIPE<br>LASKNLKNDYRILSQTLCELCDKSPNLFLKKNERLRKCVEVDINNADS<br>SMTRKYRNCIAHLTVVRELKEYIGDICTVDSYFSIYHYVMQRCITKRE<br>NDTKQEEKIKYEDDLLKNHGYTKDFVKALNSPFGYNIPRFKNLSIEQL<br>FDRNEYLTEK |
| P1E0Cas13d (SEQ ID NO: 236) | MEREVKKPPKKSLAKAAGLKSTFVISPQEKELAMTAFGRGNDALLQK<br>RIVDGVVRDVAGEKQQFQVQRQDESRFRLQNSRLADRTVTADDPLH<br>RAETPRRQPLGAGMDQLRRKAILEQKYFGRTFDDNIHIQLIYNILDIHK<br>MLAVPANHIVHTLNLLGGYGETDFVGMLPAGLPYDKLRVVKKKNGD<br>TVDIKADIAAYAKRPQLAYLGAAFYDVTPGKSKRDAARGRVKREQD<br>VYAILSLMSLLRQFCARDSVRIWGQNTTAALYHLQALPQDMKDLLD<br>DGWRRALGGVNDHFLDTNKVNLLTLFEYYGAETKQARVALTQDFYR<br>FVVLKEQKNMGFSLRRLREELLKLPDAAYLTGQEYDSVRQKLYMLL<br>DFLLCRLYAQERADRCEELVSALRCALSDEEKDTVYQAEAAALWQA<br>LGDTLRRKLLPLLKGKKLQDKDKKKSDELGLSRDVLDGVLFRPAQQG<br>SRANADYFCRLMHLSTWFMDGKEINTLLTTLISKLENIDSLRSVLESM<br>GLAYSFVPAYAMFDHSRYIAGQLRVVNNIARMRKPAIGAKREMYRA<br>AVVLLGVDSPEAAAAITDDLLQIDPETGKVRPRSDSARDTGLRNFIAN<br>NVVESRRFTYLLRYMTPEQARVLAQNEKLIAFVLSTVPDTQLERYCRT<br>CGREDITGRPAQIRYLTAQIMGVRYESFTDVEQRGRGDNPKKERYKA<br>LIGLYLTVLYLAVKNMVNCNARYVIAFYCRDRDTALYQKEVCWYDL<br>EEDKKSGKQRQVEDYTALTRYFVSQGYLNRHACGYLRSNIVINGISNSL<br>LTAYRNAVDHLNAIPPLGSLCRDIGRVDSYFALYHYAVQQYLNGRYY<br>RKTPREQELFAAMAQHRTWCSDLVKALNTPFGYNLARYKNLSIDGLF<br>DREGDHVVREDGEKPAE |
| RffCas13d (SEQ ID NO: 237) | MKKKMSLREKREAEKQAKKAAYSAASKNTDSKPAEKKAETPKPAEII<br>SDNSRNKTAVKAAGLKSTIISGDKLYMTSFGKGNAAVIEQKIDINDYS<br>FSAMKDTPSLEVDKAESKEISFSSHHPFVKNDKLTTYNPLYGGKDNPE<br>KPVGRDMLGLKDKLEERYFGCTFNDNLHIQIIYNILDIEKILAVHSANI<br>TTALDHMVDEDDEKYLNSDYIGYMNTINTYDVFMDPSKNSSLSPKDR<br>KNIDNSRAKFEKLLSTKRLGYFGFDYDANGKDKKKNEEIKKRLYHLT<br>AFAGQLRQWSFHSAGNYPRTWLYKLDSLDKEYLDTLDHYFDKRFND<br>INDDFVTKNATNLYILKEVFPEANFKDIADLYYDFIVIKSHKNMGFSIK<br>KLREKMLECDGADRIKEQDMDSVRSKLYKLIDFCIFKYYHEFPELSEK<br>NVDILRAAVSDTKKDNLYSDEAARLWSIFKEKFLGFCDKIVVWVTGE<br>HEKDITSVIDKDAYRNRSNVSYFSKLMYAMCFFLDGKEINDLLTTLIN<br>KFDNIANQIKTAKELGINTAFVKNYDFFNHSEKYVDELNIVKNIARMK<br>KPSSNAKKAMYHDALTILGIPEDMDEKALDEELDLILEKKTDPVTGKP<br>LKGKNPLRNFIANNVIENSRFIYLIKFCNPENVRKIVNNTKVTEFVLKRI<br>PDAQIERYYKSCTDSEMNPPTEKKITELAGKLKDMNFGNFRNVRQSA<br>KENMEKERFKAVIGLYLTVVYRVVKNLVDVNSRYIMAFHSLERDSQL<br>YNVSVDNDYLALTDTLVKEGDNSRSRYLAGNKRLRDCVKQDIDNAK<br>KWFVSDKYNSITKYRNNVAHLTAVRNCAEFIGDITKIDSYFALYHYLI<br>QRQLAKGLDHERSGFDRNYPQYAPLFKWHTYVKDVVKALNAPFGYN<br>IPRFKNLSIDALFDRNEIKKNDGEKKSDD |
| RaCas13d (SEQ ID NO: 238) | MAKKSKGMSLREKRELEKQKRIQKAAVNSVNDTPEKTEEANVVSVN<br>VRTSAENKHSKKSAAKALGLKSGLVIGDELYLTSFGRGNEAKLEKKIS<br>GDTVEKLGIGAFEVAERDESTLTLESGRIKDKTARPKDPRHITVDTQG<br>KFKEDMLGIRSVLEKKIFGKTFDDNIHVQLAYNILDVEKIMAQYVSDI |

TABLE 5-continued

| | |
|---|---|
| | VYMLHNTDKTERNDNLMGYMSIRNTYKTFCDTSNLPDDTKQKVENQ<br>KREFDKIIKSGRLGYFGEAFMVNSGNSTKLRPEKEIYHIFALMASLRQS<br>YFHGYVKDTDYQGTTWAYTLEDKLKGPSHEFRETIDKIFDEGFSKISK<br>DFGKMNKVNLQILEQMIGELYGSIERQNLTCDYYDFIQLKKHKYLGFS<br>IKRLRETMLETTPAECYKAECYNSERQKLYKLIDFLIYDLYYNRKPARI<br>EEIVDKLRESVNDEEKESIYSVEAKYVYESLSKVLDKSLKNSVSGETIK<br>DLQKRYDDETANRIWDISQHSISGNVNCFCKLIYIMTLMLDGKEINDL<br>LTTLVNKFDNIASFIDVMDELGLEHSFTDNYKMFADSKAICLDLQFINS<br>FARMSKIDDEKSKRQLFRDALVILDIGNKDETWINNYLDSDIFKLDKE<br>GNKLKGARHDFRNFIANNVIKSSRFKYLVKYSSADGMIKLKTNEKLIG<br>FVLDKLPETQIDRYYESCGLDNAVVDKKVRIEKLSGLIRDMKFDDFSG<br>VKTSNKAGDNDKQDKAKYQAIISLYLMVLYQIVKNMIYVNSRYVIAF<br>HCLERDFGMYGKDFGKYYQGCRKLTDHFIEEKYMKEGKLGCNKKV<br>GRYLKNNISCCTDGLINTYRNQVDHFAVVRKIGNYAAYIKSIGSWFEL<br>YHYVIQRIVFDEYRFALNNTESNYKNSIIKHHTYCKDMVKALNTPFGY<br>DLPRYKNLSIGDLFDRNNYLNKTKESIDANSSIDSQ |
| EsCas13d<br>(SEQ ID<br>NO: 239) | MGKKIHARDLREQRKTDRTEKFADQNKKREAERAVPKKDAAVSVKS<br>VSSVSSKKDNVTKSMAKAAGVKSVFAVGNTVYMTSFGRGNDAVLEQ<br>KIVDTSHEPLNIDDPAYQLNVVTMNGYSVTGHRGETVSAVTDNPLRR<br>FNGRKKDEPEQSVPTDMLCLKPTLEKKFFGKEFDDNIHIQLIYNILDIE<br>KILAVYSTNAIYALNNMSADENIENSDFFMKRTTDETFDDFEKKKEST<br>NSREKADFDAFEKFIGNYRLAYFADAFYVNKKNPKGKAKNVLREDK<br>ELYSVLTLIGKLRHWCVHSEEGRAEFWLYKLDELKDDFKNVLDVVY<br>NRPVEEINNRFIENNKVNIQILGSVYKNTDIAELVRSYYEFLITKKYKN<br>MGFSIKKLRESMLEGKGYADKEYDSVRNKLYQMTDFILYTGYINEDS<br>DRADDLVNTLRSSLKEDDKTTVYCKEADYLWKKYRESIREVADALD<br>GDNIKKLSKSNIEIQEDKLRKCFISYADSVSEFTKLIYLLTRFLSGKEIN<br>DLVTTLINKFDNIRSFLEIMDELGLDRTFTAEYSFFEGSTKYLAELVEL<br>NSFVKSCSFDINAKRTMYRDALDILGIESDKTEEDIEKMIDNILQIDAN<br>GDKKLKKNNGLRNFIASNVIDSNRFKYLVRYGNPKKIRETAKCKPAV<br>RFVLNEIPDAQIERYYEACCPKNTALCSANKRREKLADMIAEIKFENFS<br>DAGNYQKANVTSRTSEAEIKRKNQAIIRLYLTVMYIMLKNLVNVNAR<br>YVIAFHCVERDTKLYAESGLEVGNIEKNKTNLTMAVMGVKLENGIIK<br>TEFDKSFAENAANRYLRNARWYKLILDNLKKSERAVVNEFRNTVCHL<br>NAIRNININIKEIKEVENYFALYHYLIQKHLENRFADKKVERDTGDFIS<br>KLEEHKTYCKDFVKAYCTPFGYNLVRYKNLTIDGLFDKNYPGKDDSD<br>EQK |

Cas13 Variants and Mutations

The present disclosure provides for variants and mutated forms of Cas proteins. In some examples, the present disclosure includes variants and mutated forms of Cas 13, e.g., Cas13b. The variants or mutated forms of Cas protein may be catalytically inactive, e.g., have no or reduced nuclease activity compared to a corresponding wildtype. In certain examples, the variants or mutated forms of Cas protein have nickase activity.

Mutations of Cas13

In some cases, the present disclosure provides for mutated Cas13 proteins comprising one or more modified of amino acids, wherein the amino acids: (a) interact with a guide RNA that forms a complex with the mutated Cas 13 protein; (b) are in a HEPN active site, an inter-domain linker domain, or a bridge helix domain of the mutated Cas 13 protein; or a combination thereof.

The term "corresponding amino acid" or "residue which corresponds to" refers to a particular amino acid or analogue thereof in a Cas13 homologue or orthologue that is identical or functionally equivalent to an amino acid in reference Cas protein. Accordingly, as used herein, referral to an "amino acid position corresponding to amino acid position [X]" of a specified Cas 13 protein represents referral to a collection of equivalent positions in other recognized Cas 13 and structural homologues and families. The mutations described herein apply to all Cas13 protein that is orthologs or homologs of the referred Cas protein (e.g., PbCas13b). For example, the mutations apply to Cas13a, Cas13b, Cas13c, Cas13d, Cas13b-t1, Cas13b-t2, or Cas13b-t3.

In an aspect, the invention relates to a mutated Cas13 protein comprising one or more mutation of an amino acid corresponding to the following amino acids of *Prevotella buccae* Cas13b (PbCas13b): T405, H407, K457, H500, K570, K590, N634, R638, N652, N653, K655, S658, K741, K744, N756, S757, R762, R791, K846, K857, K870, R877, K183, K193, R600, K607, K612, R614, K617, K826, K828, K829, R824, R830, Q831, K835, K836, R838, R618, D434, K431, R53, K943, R1041, Y164, R285, R287, K292, E296, N297, Q646, N647, R402, K393, N653, N652, R482, N480, D396, E397, D398, E399, K294, E400, R56, N157, H161, H452, N455, K484, N486, G566, H567, A656, V795, A796, W842, K871, E873, R874, R1068, N1069, or H1073.

PbCas13b as used herein preferably has the sequence of NCBI™ Reference Sequence WP_004343973.1. It is to be understood that WP_004343973.1 refers to the wild type (i.e. unmutated) PbCas13b. LshCas13a (*Leptotrichia shahii* Cas13a) as used herein preferably has the sequence of NCBI™ Reference Sequence WP_018451595.1. It is to be understood that WP_018451595.1 refers to the wild type (i.e. unmutated) LshCas13b. Pgu Cas13b (*Porphyromonas gulae* Cas13b) as used herein preferably has the sequence of NCBI™ Reference Sequence WP_039434803.1. It is to be understood that WP_039434803.1 refers to the wild type (i.e. unmutated) Pgu Cas13b. Psp Cas13b (*Prevotella* sp. P5-125 Cas13b) as used herein preferably has the sequence of NCBI™ Reference Sequence WP_044065294.1. It is to be understood that WP_044065294.1 refers to the wild type (i.e. unmutated) Psp Cas13b.

In embodiments of the invention, a Type VI system comprises a mutated Cas13 effector protein according to the invention as described herein (and optionally a small accessory protein encoded upstream or downstream of a Cas13b effector protein). In certain embodiments, the small accessory protein enhances the Cas13b effector's ability to target RNA.

Insights from the structure of Cas13 enables further rational engineering to improve functionality for RNA targeting specificity, base editing, and nucleic acid detection, etc. Based on the elucidated crystal structure of the Cas13 effector with its crRNA described herein, functional implications of rational engineering and mutagenesis can be postulated, of which non-limiting mutations are exemplified in Table 6 below (with reference to PbCas13b; WP 004343973.1).

TABLE 6

| Residue | Descrption | Expected result |
|---|---|---|
| T405 | coordinates first base of guide (U) | alter activity |
| H407 | basestacking with UO | possible PFS involvment |
| H407Y/W/F | basestacking with UO | alter PFS |
| K457 | direct readout of A31 | |
| H500 | hydrogen bond with bb of G11 | alter activity |
| K570 | direct readout of G25 | alter activity |
| K590 | bb of U27 | alter activity |
| N634 | bb of A29 | alter activity |
| R638 | bb of A28 | alter activity |
| N652 | direct readout of U2 and C36 | alter activity |
| N653 | direct readout of C36 | alter activity |
| K655 | hydrogen bonds with bb of na 3 | alter activity |
| S658 | coordinates first base of guide | alter activity |
| K741 | direct readout of U27 | alter activity |
| K744 | hydrogen bonds with bb of na 6 | alter activity |
| N756 | direct readout of C33 and C5 | alter activity |
| S757 | direct readout of A32 | alter activity |
| R762 | hydrogen bond with bb of G10 | alter activity |
| R791 | bb of A22 | alter activity |
| K846 | hydrogen bond with bb of U18 | alter activity |
| K857 | hydrogen bond with bb of C15 | alter activity |
| K870 | hydrogen bond with base of U19 | alter activity |
| R877 | direct readout of U18 | alter activity |
| | Channels | |
| K183 | Outerchannel rim | alter activity |
| K193 | Outerchannel rim | alter activity |
| R600 | Outerchannel rim | alter activity |
| K607 | Outerchannel rim | alter activity |
| K612 | Outerchannel rim | alter activity |
| R614 | Outerchannel rim | alter activity |
| K617 | Outerchannel rim | alter activity |
| K826 | Bridge helix domain | alter activity |
| K828 | Bridge helix domain | alter activity |
| K829 | Bridge helix domain | alter activity |
| R824 | Bridge helix domain | alter activity |
| R830 | Bridge helix domain | alter activity |
| Q831 | Bridge helix domain | alter activity |
| K835 | Bridge helix domain | alter activity |
| K836 | Bridge helix domain | alter activity |
| R838 | Bridge helix domain | alter activity |
| R618 | conserved outer channel arginien | alter activity |
| D434 | Conserved loop | alter activity |
| K431 | Conserved loop | alter activity |
| | Active site pocket | |
| 46-57 | HEP1 | |
| 73-79 | HEP1 | |
| 152-164 | HEP1 | |
| 1036-1046 | HEP2 | |
| 1064-1074 | HEP2 | |
| R53A/K/D/E | HEP1 | change in base specificity |
| K943A/R/D/E | HEP2 | change in base specificity |
| R1041A/K/D/E | HEP2 | change in base specificity |
| Y164A/F/W | | affect base stacking at active site |

TABLE 6-continued

| Residue | Descrption | Expected result |
|---|---|---|
| | Interdomain linker | |
| 285-299 | | |
| R285 | central channel active pocket | alter activity |
| R287 | central channel active pocket | alter activity |
| K292 | central channel active pocket | alter activity |
| E296 | central channel active pocket | alter activity |
| N297 | central channel active pocket | alter activity |
| | Other | |
| | Trans active site loop | alter activity |
| Q646 | Trans active site loop | alter activity |
| N647 | Trans active site loop | alter activity |
| | HEPN interface | |
| | crRNA processiong | |
| R402 | remove crRNA processing | alter crRNA processing |
| K393 | remove crRNA processing | alter crRNA processing |
| N653 | remove crRNA processing | alter crRNA processing |
| N652 | remove crRNA processing | alter crRNA processing |
| R482 | remove crRNA processing | alter crRNA processing |
| N480 | remove crRNA processing | alter crRNA processing |
| | LID domain | |
| D396 | hairpin with unknown function | alter crRNA processing |
| E397 | hairpin with unknown function | alter crRNA processing |
| D398 | hairpin with unknown function | alter crRNA processing |
| E399 | hairpin with unknown function | alter crRNA processing |
| K294 | IDL | alter activity |

Structural (Sub)Domains

In another aspect, the disclosure provides a mutated Cas13 protein comprising one or more mutations of amino acids, wherein the amino acids: interact with a guide RNA that forms a complex with the engineered Cas 13 protein; or are in a HEPN active site, a lid domain, a helical domain, selected from a helical 1 or a helical 2 domain, an interdomain linker (IDL) domain, or a bridge helix domain of the mutated Cas 13 protein, or a combination thereof.

Figure 4A:
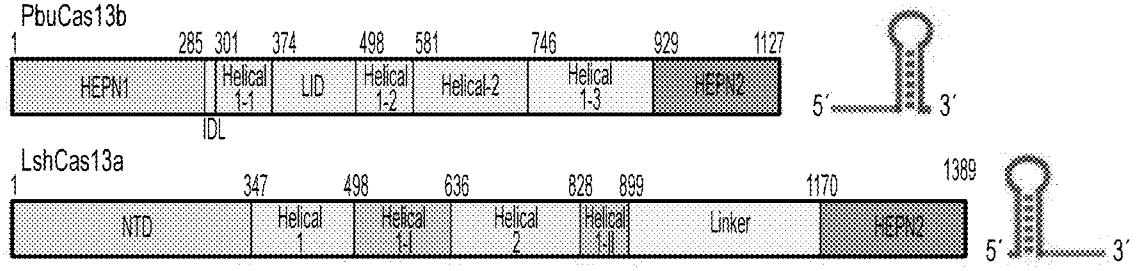
FIGS. 4A-4C. PbuCas13b comparison to LshCas13a architecture and active site.

Based on the crystal structure of the Cas protein, different structural domains can be identified. In addition to sequence alignments, the information of the crystal structure and domain architecture allows corresponding amino acids of different orthologues (e.g. Cas13b orthologues) and homologues (other Cas13 proteins, such as Cas13a, Cas13c, or Cas13d) to be identified. By means of example, and without limitation, the crystal structure of PbCas13b in complex with crRNA as reported herein, identifies the following structural domains (see also FIG. 1A): HEPN1 and HEPN2 (catalytic domains, respectively spanning from amino acid 1 to 285 and 930 to 1127); IDL (interdomain linker, spanning from amino acids 286 to 301); helical domains 1 and 2, whereby helical domain is split in helical domain 1-1, 1-2, and 1-3 (respectively spanning from amino acids 302 to 374, 499 to 581, and 747 to 929), and helical domain 2 spanning from amino acids 582 to 746; LID (spanning from amino acids 375 to 498). Helical domain 1, in particular helical domain 1-3 encompasses a bridge helix as a discernible subdomain. Accordingly, particular mutations according to the invention as described herein, apart from having a specified amino acid position in the Cas13 polypeptide can also be linked to a particular structural domain of the Cas13 protein. Hence a corresponding amino acid in a Cas13 orthologue or homologue can have a specified amino acid position in the Cas13 polypeptide as well as belong to a corresponding structural domain (see also for instance FIG. 4 as an example of corresponding amino acids in HEPN1 and HEPN2 of Cas13a and Cas13b). Mutations may be identified by locations in structural (sub) domains, by position corresponding to amino acids of a particular Cas13 protein (e.g. PbCas13b), by interactions with a guide RNA, or a combination thereof.

The types of mutations can be conservative mutations or non-conservative mutations. In certain preferred embodiments, the amino acid which is mutated is mutated into alanine (A). In certain preferred embodiments, if the amino acid to be mutated is an aromatic amino acid, it is mutated into alanine or another aromatic amino acid (e.g. H, Y, W, or F). In certain preferred embodiments, if the amino acid to be mutated is a charged amino acid, it is mutated into alanine or another charged amino acid (e.g. H, K, R, D, or E). In certain preferred embodiments, if the amino acid to be mutated is a charged amino acid, it is mutated into alanine or another charged amino acid having the same charge. In certain preferred embodiments, if the amino acid to be mutated is a charged amino acid, it is mutated into alanine or another charged amino acid having the opposite charge.

The invention also provides for methods and compositions wherein one or more amino acid residues of the effector protein may be modified e.g., an engineered or non-naturally-occurring effector protein or Cas13. In an embodiment, the modification may comprise mutation of one or more amino acid residues of the effector protein. The one or more mutations may be in one or more catalytically active domains of the effector protein, or a domain interacting with the crRNA (such as the guide sequence or direct repeat sequence). The effector protein may have reduced or abolished nuclease activity or alternatively increased nuclease activity compared with an effector protein lacking said one or more mutations. The effector protein may not direct cleavage of the RNA strand at the target locus of interest. In a preferred embodiment, the one or more mutations may comprise two mutations. In a preferred embodiment the one or more amino acid residues are modified in a Cas13b effector protein, e.g., an engineered or non-naturally-occurring effector protein or Cas13b. In some cases, the CRISPR-Cas protein comprises one or more mutations in the helical domain.

The Cas13 protein herein may comprise one or more mutations. In some cases, the Cas13 protein comprises one or more mutations of amino acid corresponding to the following amino acids of *Prevotella buccae* Cas13b (PbCas13b): T405, H407, K457, H500, K570, K590, N634, R638, N652, N653, K655, S658, K741, K744, N756, S757, R762, R791, K846, K857, K870, R877, K183, K193, R600, K607, K612, R614, K617, K826, K828, K829, R824, R830, Q831, K835, K836, R838, R618, D434, K431, R53, K943, R1041, Y164, R285, R287, K292, E296, N297, Q646, N647, R402, K393, N653, N652, R482, N480, D396, E397, D398, E399, K294, E400, R56, N157, H161, H452, N455, K484, N486, G566, H567, A656, V795, A796, W842, K871, E873, R874, R1068, N1069, or H1073.

In some cases, the Cas13 protein comprises one or more mutations of an amino acid corresponding to the following amino acids of *Prevotella buccae* Cas13b (PbCas13b): H407, K457, H500, K570, K590, N634, R638, N652, N653, K655, S658, K741, K744, N756, S757, R762, R791, K846, K857, K870, R877, K183, K193, R600, K607, K612, R614, K617, K826, K828, K829, R824, R830, Q831, K835, K836, R838, R618, D434, K431, R53, K943, R1041, Y164, R285, R287, K292, E296, N297, Q646, N647, R402, K393, N653, N652, R482, N480, D396, E397, D398, E399, K294, E400, R56, N157, H161, H452, N455, K484, N486, G566, H567, W842, K871, E873, R874, R1068, N1069, or H1073.

In some cases, the Cas13 protein comprises one or more mutations of an amino acid corresponding to the following amino acids of *Prevotella buccae* Cas13b (PbCas13b): T405, H407, K457, H500, K570, K590, N634, R638, N652, N653, K655, S658, K741, K744, N756, S757, R762, R791, K846, K857, K870, R877, K183, K193, R600, K607, K612, R614, K617, K826, K828, K829, R824, R830, Q831, K835, K836, R838, R618, D434, K431, R53, K943, R1041, Y164, R285, R287, K292, E296, N297, Q646, N647, R402, K393, N653, N652, R482, N480, D396, E397, D398, E399, K294, or E400.

In some cases, the Cas13 protein comprises one or more mutations of an amino acid corresponding to the following amino acids of *Prevotella buccae* Cas13b (PbCas13b): K393, R402, N482, T405, H407, S658, N653, A656, K655, N652, H567, N455, H500, K871, K857, K870, W842, E873, R877, K846, R874, R762, V795, A796, R791, G566, K590, R638, H452, S757, N756, N486, K484, N480, K457, K741, R56, N157, H161, R1068, N1069, or H1073. In some cases, the Cas13 protein comprises one or more mutations of an amino acid corresponding to the following amino acids of PbCas13b: K393, R402, N482, H407, S658, N653, K655, N652, H567, N455, H500, K871, K857, K870, W842, E873, R877, K846, R874, R762, R791, G566, K590, R638, H452, S757, N756, N486, K484, N480, K457, K741, R56, N157, H161, R1068, N1069, or H1073.

In some cases, the Cas13 protein comprises one or more mutations of an amino acid corresponding to the following amino acids of PbCas13b: W842, K846, K870, E873, or R877. In some cases, the Cas13 protein comprises in helical domain 1 one or more mutations of an amino acid corresponding to the following amino acids in helical domain 1 of PbCas13b: W842, K846, K870, E873, or R877. In some cases, the Cas13 protein comprises in helical domain 1-3 one or more mutations of an amino acid corresponding to the following amino acids in helical domain 1-3 of PbCas13b: W842, K846, K870, E873, or R877. In some cases, the Cas13 protein comprises in the helical bridge domain one or more mutations of an amino acid corresponding to the following amino acids in the helical bridge domain of PbCas13b: W842, K846, K870, E873, or R877. In some cases, the Cas13 protein comprises one or more mutations of an amino acid corresponding to the following amino acids of PbCas13b: K393, R402, N480, N482, N652, or N653. In some cases, the Cas13 protein comprises one or more mutations of an amino acid corresponding to the following amino acids of PbCas13b: K393, R402, N480, or N482. In some cases, the Cas13 protein comprises in the LID domain one or more mutations of an amino acid corresponding to the following amino acids in the LID domain of PbCas13b: K393, R402, N480, or N482. In some cases, the Cas13 protein comprises one or more mutations of an amino acid corresponding to the following amino acids of PbCas13b: N652 or N653. In some cases, the Cas13 protein comprises in helical domain 2 one or more mutations of an amino acid corresponding to the following amino acids in helical domain 2 of PbCas13b: N652 or N653.

In some cases, the Cas13 protein comprises one or more mutations of an amino acid corresponding to the following amino acids of PbCas13b: T405, H407, S658, N653, A656, K655, N652, H567, N455, H500, K871, K857, K870, W842, E873, R877, K846, R874, R762, V795, A796, R791, G566, K590, R638, H452, S757, N756, N486, K484, N480, K457, or K741. In some cases, the Cas13 protein comprises one or more mutations of an amino acid corresponding to the following amino acids of PbCas13b: H407, S658, N653, K655, N652, H567, N455, H500, K871, K857, K870, W842, E873, R877, K846, R874, R762, R791, G566, K590, R638, H452, S757, N756, N486, K484, N480, K457, or K741. In some cases, the Cas13 protein comprises one or more mutations of an amino acid corresponding to the following amino acids of PbCas13b: S658, N653, A656, K655, N652, H567, H500, K871, K857, K870, W842, E873, R877, K846, R874, R762, V795, A796, R791, G566, K590, R638, S757, N756, or K741. In some cases, the Cas13 protein comprises in a helical domain one or more mutations of an amino acid corresponding to the following amino acids in a helical domain of PbCas13b: S658, N653, A656, K655, N652, H567, H500, K871, K857, K870, W842, E873, R877, K846, R874, R762, V795, A796, R791, G566, K590, R638, S757, N756, or K741.

In some cases, the Cas13 protein comprises one or more mutations of an amino acid corresponding to the following amino acids of PbCas13b: H567, H500, K871, K857, K870, W842, E873, R877, K846, R874, R762, V795, A796, R791, G566, S757, or N756. In some cases, the Cas13 protein comprises in helical domain 1 one or more mutations of an amino acid corresponding to the following amino acids in helical domain 1 of PbCas13b: H567, H500, K871, K857, K870, W842, E873, R877, K846, R874, R762, V795, A796, R791, G566, S757, or N756. In some cases, the Cas13 protein comprises one or more mutations of an amino acid corresponding to the following amino acids of PbCas13b: H567, H500, R762, V795, A796, R791, G566, S757, or N756. In some cases, the Cas13 protein comprises in helical domain 1 one or more mutations of an amino acid corresponding to the following amino acids in helical domain 1 of PbCas13b: H567, H500, R762, V795, A796, R791, G566, S757, or N756.

In some cases, the Cas13 protein comprises one or more mutations of an amino acid corresponding to the following amino acids of PbCas13b: K871, K857, K870, W842, E873, R877, K846, or R874. In some cases, the Cas13 protein comprises in the helical bridge domain one or more mutations of an amino acid corresponding to the following amino acids in the helical bridge domain of PbCas13b: K871, K857, K870, W842, E873, R877, K846, or R874. In some cases, the Cas13 protein comprises one or more mutations of an amino acid corresponding to the following amino acids of PbCas13b: H567, H500, or G566. In some cases, the Cas13 protein comprises in helical domain 1-2 one or more mutations of an amino acid corresponding to the following amino acids in helical domain 1-2 of PbCas13b: H567, H500, or G566. In some cases, the Cas13 protein comprises one or more mutations of an amino acid corresponding to the following amino acids of PbCas13b: K871, K857, K870, W842, E873, R877, K846, R874, R762, V795, A796, R791, S757, or N756. In some cases, the Cas13 protein comprises in helical domain 1-3 one or more mutation of an amino acid corresponding to the following amino acids in helical domain 1-3 of PbCas13b: K871, K857, K870, W842, E873, R877, K846, R874, R762, V795, A796, R791, S757, or N756. In some cases, the Cas13 protein comprises one or more mutations of an amino acid corresponding to the following amino acids of PbCas13b: R762, V795, A796, R791, S757, or N756. In some cases, the Cas13 protein comprises in helical domain 1-3 one or more mutation of an amino acid corresponding to the following amino acids in helical domain 1-3 of PbCas13b: R762, V795, A796, R791, S757, or N756. In some cases, the Cas13 protein comprises one or more mutations of an amino acid corresponding to the following amino acids of PbCas13b: S658, N653, A656, K655, N652, K590, R638, or K741. In some cases, the Cas13 protein comprises in helical domain 2 one or more mutations of an amino acid corresponding to the following amino acids in helical domain 2 of PbCas13b: S658, N653, A656, K655, N652, K590, R638, or K741. In some cases, the Cas13 protein comprises one or more mutations of an amino acid corresponding to the following amino acids of PbCas13b: T405, H407, N486, K484, N480, H452, N455, or K457. In some cases, the Cas13 protein comprises in the LID domain one or more mutations of an amino acid corresponding to the following amino acids in the LID domain of PbCas13b: T405, H407, N486, K484, N480, H452, N455, or K457. In some cases, the Cas13 protein comprises one or more mutations of an amino acid corresponding to the following amino acids of PbCas13b: S658, N653, K655, N652, H567, H500, K871, K857, K870, W842, E873, R877, K846, R874, R762, R791, G566, K590, R638, S757, N756, or K741.

In some cases, the Cas13 protein comprises in a helical domain one or more mutations of an amino acid corresponding to the following amino acids in a helical domain of PbCas13b: S658, N653, K655, N652, H567, H500, K871, K857, K870, W842, E873, R877, K846, R874, R762, R791, G566, K590, R638, S757, N756, or K741. In some cases, the Cas13 protein comprises one or more mutations of an amino acid corresponding to the following amino acids of PbCas13b: H567, H500, K871, K857, K870, W842, E873, R877, K846, R874, R762, R791, G566, S757, or N756. In some cases, the Cas13 protein comprises in helical domain 1 one or more mutations of an amino acid corresponding to the following amino acids in helical domain 1 of PbCas13b: H567, H500, K871, K857, K870, W842, E873, R877, K846, R874, R762, R791, G566, S757, or N756. In some cases, the Cas13 protein comprises one or more mutations of an amino acid corresponding to the following amino acids of PbCas13b: H567, H500, R762, R791, G566, S757, or N756. In some cases, the Cas13 protein comprises in helical domain 1 one or more mutations of an amino acid corresponding to the following amino acids in helical domain 1 of PbCas13b: H567, H500, R762, R791, G566, S757, or N756. In some cases, the Cas13 protein comprises one or more mutations of an amino acid corresponding to the following amino acids of PbCas13b: K871, K857, K870, W842, E873, R877, K846, R874, R762, R791, S757, or N756. In some cases, the Cas13 protein comprises in helical domain 1-3 one or more mutations of an amino acid corresponding to the following amino acids in helical domain 1-3 of PbCas13b: K871, K857, K870, W842, E873, R877, K846, R874, R762, R791, S757, or N756. In some cases, the Cas13 protein comprises one or more mutations of an amino acid corresponding to the following amino acids of PbCas13b: R762, R791, S757, or N756. In some cases, the Cas13 protein comprises in helical domain 1-3 one or more mutations of an amino acid corresponding to the following amino acids in helical domain 1-3 of PbCas13b: R762, R791, S757, or N756.

In some cases, the Cas13 protein comprises one or more mutations of an amino acid corresponding to the following amino acids of PbCas13b: S658, N653, K655, N652, K590, R638, or K741. In some cases, the Cas13 protein comprises in helical domain 2 one or more mutations of an amino acid corresponding to the following amino acids in helical domain 2 of PbCas13b: S658, N653, K655, N652, K590, R638, or K741.

In some cases, the Cas13 protein comprises one or more mutations of an amino acid corresponding to the following amino acids of PbCas13b: H407, N486, K484, N480, H452, N455, or K457. In some cases, the Cas13 protein comprises in the LID domain one or more mutations of an amino acid corresponding to the following amino acids in the LID domain of PbCas13b: H407, N486, K484, N480, H452, N455, or K457.

In some cases, the Cas13 protein comprises one or more mutations of an amino acid corresponding to the following amino acids of PbCas13b: R56, N157, H161, R1068, N1069, or H1073. In some cases, the Cas13 protein comprises in a HEPN domain one or more mutations of an amino acid corresponding to the following amino acids in a HEPN domain of PbCas13b: R56, N157, H161, R1068, N1069, or H1073.

In some cases, the Cas13 protein comprises one or more mutations of an amino acid corresponding to the following amino acids of PbCas13b: R56, N157, or H161. In some cases, the Cas13 protein comprises in HEPN domain 1 one or more mutations of an amino acid corresponding to the following amino acids in HEPN domain 1 of PbCas13b: R56, N157, or H161. In some cases, the Cas13 protein comprises one or more mutations of an amino acid corresponding to the following amino acids of PbCas13b: R1068, N1069, or H1073. In some cases, the Cas13 protein comprises in HEPN domain 2 one or more mutations of an amino acid corresponding to the following amino acids in HEPN domain 2 of PbCas13b: R1068, N1069, or H1073.

In some cases, the Cas13 protein comprises one or more mutations of an amino acid corresponding to the following amino acids of PbCas13b: K393, R402, N482, T405, H407, N486, K484, N480, H452, N455, or K457. In some cases, the Cas13 protein comprises in the LID domain one or more mutations of an amino acid corresponding to the following amino acids in the LID domain of PbCas13b: K393, R402, N482, T405, H407, N486, K484, N480, H452, N455, or K457. In some cases, the Cas13 protein comprises one or more mutations of an amino acid corresponding to the following amino acids of PbCas13b: K393, R402, N482, H407, N486, K484, N480, H452, N455, or K457. In some cases, the Cas13 protein comprises in the LID domain one or more mutations of an amino acid corresponding to the following amino acids in the LID domain of PbCas13b: K393, R402, N482, H407, N486, K484, N480, H452, N455, or K457.

In some cases, the Cas13 protein comprises one or more mutations of an amino acid corresponding to the following amino acids of PbCas13b: T405, H407, S658, N653, A656, K655, N652, H567, N455, H500, K871, K857, K870, W842, E873, R877, K846, R874, R762, V795, A796, R791, G566, K590, R638, H452, S757, N756, N486, K484, N480, K457, K741, K393, R402, or N482. In some cases, the Cas13 protein comprises one or more mutations of an amino acid corresponding to the following amino acids of PbCas13b: H407, S658, N653, K655, N652, H567, N455, H500, K871, K857, K870, W842, E873, R877, K846, R874, R762, R791, G566, K590, R638, H452, S757, N756, N486, K484, N480, K457, K741, K393, R402, or N482.

In some cases, the Cas13 protein comprises one or more mutations of an amino acid corresponding to the following amino acids of PbCas13b: S658, N653, A656, K655, N652, H567, N455, H500, K871, K857, K870, W842, E873, R877, K846, R874, R762, V795, A796, R791, G566, K590, R638, H452, S757, N756, N486, K484, N480, K457, or K741. In some cases, the Cas13 protein comprises one or more mutations of an amino acid corresponding to the following amino acids of PbCas13b: S658, N653, K655, N652, H567, N455, H500, K871, K857, K870, W842, E873, R877, K846, R874, R762, R791, G566, K590, R638, H452, S757, N756, N486, K484, N480, K457, or K741.

In some cases, the Cas13 protein comprises one or more mutations of an amino acid corresponding to the following amino acids of PbCas13b: N486, K484, N480, H452, N455, or K457. In some cases, the Cas13 protein comprises in the LID domain one or more mutations of an amino acid corresponding to the following amino acids in the LID domain of PbCas13b: N486, K484, N480, H452, N455, or K457. In some cases, the Cas13 protein comprises one or more mutations of an amino acid corresponding to the following amino acids of PbCas13b: K393, R402, N482, N486, K484, N480, H452, N455, or K457. In some cases, the Cas13 protein comprises in the LID domain one or more mutations of an amino acid corresponding to the following amino acids in the LID domain of PbCas13b: K393, R402, N482, N486, K484, N480, H452, N455, or K457.

In some cases, the Cas13 protein comprises one or more mutations of an amino acid corresponding to the following amino acids of PbCas13b: S658, N653, A656, K655, N652, H567, N455, H500, K871, K857, K870, W842, E873, R877, K846, R874, R762, V795, A796, R791, G566, K590, R638, H452, S757, N756, N486, K484, N480, K457, K741, K393, R402, or N482. In some cases, the Cas13 protein comprises one or more mutations of an amino acid corresponding to the following amino acids of PbCas13b: S658, N653, K655, N652, H567, N455, H500, K871, K857, K870, W842, E873, R877, K846, R874, R762, R791, G566, K590, R638, H452, S757, N756, N486, K484, N480, K457, K741, K393, R402, or N482.

In some cases, the Cas13 protein comprises one or more mutations of an amino acid corresponding to the following amino acids of *Prevotella buccae* Cas13b (PbCas13b): R53, Y164, K943, or R1041. In some cases, the Cas13 protein comprises one or more mutations of an amino acid corresponding to the following amino acids of *Prevotella buccae* Cas13b (PbCas13b): R53 or Y164.

In some cases, the Cas13 protein comprises one or more mutations of an amino acid corresponding to the following amino acids of *Prevotella buccae* Cas13b (PbCas13b): K943 or R1041. In some cases, the Cas13 protein comprises in a HEPN domain one or more mutations of an amino acid corresponding to the following amino acids in a HEPN domain of *Prevotella buccae* Cas13b (PbCas13b): R53, Y164, K943, or R1041. In some cases, the Cas13 protein comprises in HEPN domain 1 one or more mutations of an amino acid corresponding to the following amino acids in HEPN domain 1 of *Prevotella buccae* Cas13b (PbCas13b): R53 or Y164. In some cases, the Cas13 protein comprises in HEPN domain 2 one or more mutations of an amino acid corresponding to the following amino acids in HEPN domain 2 of *Prevotella buccae* Cas13b (PbCas13b): K943 or R1041.

In some cases, the Cas13 protein comprises one or more mutations of an amino acid corresponding to the following amino acids of *Prevotella buccae* Cas13b (PbCas13b): R53, Y164, K943, R1041, R56, N157, H161, R1068, N1069, or H1073.

In some cases, the Cas13 protein comprises one or more mutations of an amino acid corresponding to the following amino acids of *Prevotella buccae* Cas13b (PbCas13b): R53, Y164, R56, N157, or H161. In some cases, the Cas13 protein comprises one or more mutations of an amino acid corresponding to the following amino acids of *Prevotella buccae* Cas13b (PbCas13b): K943, R1041, R1068, N1069, or H1073. In some cases, the Cas13 protein comprises in a HEPN domain one or more mutations of an amino acid corresponding to the following amino acids in a HEPN domain of *Prevotella buccae* Cas13b (PbCas13b): R53, Y164, K943, R1041, R56, N157, H161, R1068, N1069, or H1073. In some cases, the Cas13 protein comprises in HEPN domain 1 one or more mutations of an amino acid corresponding to the following amino acids in HEPN domain 1 of *Prevotella buccae* Cas13b (PbCas13b): R53, Y164, R56, N157, or H161. In some cases, the Cas13 protein comprises in HEPN domain 2 one or more mutations of an amino acid corresponding to the following amino acids in HEPN domain 2 of *Prevotella buccae* Cas13b (PbCas13b): K943, R1041, R1068, N1069, or H1073.

In some cases, the Cas13 protein comprises one or more mutations of an amino acid corresponding to the following amino acids of *Prevotella buccae* Cas13b (PbCas13b): R53, Y164, K183, K193, K943, or R1041. In some cases, the Cas13 protein comprises one or more mutations of an amino acid corresponding to the following amino acids of *Prevotella buccae* Cas13b (PbCas13b): R53, Y164, K183, or K193. In some cases, the Cas13 protein comprises one or more mutations of an amino acid corresponding to the following amino acids of *Prevotella buccae* Cas13b (PbCas13b): K943 or R1041. In some cases, the Cas13 protein comprises in a HEPN domain one or more mutations of an amino acid corresponding to the following amino acids in a HEPN domain of *Prevotella buccae* Cas13b (PbCas13b): R53, Y164, K183, K193, K943, or R1041.

In some cases, the Cas13 protein comprises in HEPN domain 1 one or more mutations of an amino acid corresponding to the following amino acids in HEPN domain 1 of *Prevotella buccae* Cas13b (PbCas13b): R53, Y164, K183, or K193. In some cases, the Cas13 protein comprises in HEPN domain 2 one or more mutations of an amino acid corresponding to the following amino acids in HEPN domain 2 of *Prevotella buccae* Cas13b (PbCas13b): K943 or R1041. In some cases, the Cas13 protein comprises one or more mutations of an amino acid corresponding to the following amino acids of *Prevotella buccae* Cas13b (PbCas13b): R53, Y164, K183, K193, K943, R1041, R56, N157, H161, R1068, N1069, or H1073. In some cases, the Cas13 protein comprises one or more mutations of an amino acid corresponding to the following amino acids of *Prevotella buccae* Cas13b (PbCas13b): R53, Y164, K183, K193, R56, N157, or H161. In some cases, the Cas13 protein comprises one or more mutations of an amino acid corresponding to the following amino acids of *Prevotella buccae* Cas13b (PbCas13b): K943, R1041, R1068, N1069, or H1073. In some cases, the Cas13 protein comprises in a HEPN domain one or more mutations of an amino acid corresponding to the following amino acids in a HEPN domain of *Prevotella buccae* Cas13b (PbCas13b): R53, Y164, K183, K193, K943, R1041, R56, N157, H161, R1068, N1069, or H1073. In some cases, the Cas13 protein comprises in HEPN domain 1 one or more mutations of an amino acid corresponding to the following amino acids in HEPN domain 1 of *Prevotella buccae* Cas13b (PbCas13b): R53, Y164, K183, K193, R56, N157, or H161.

In some cases, the Cas13 protein comprises in HEPN domain 2 one or more mutations of an amino acid corresponding to the following amino acids in HEPN domain 2 of *Prevotella buccae* Cas13b (PbCas13b): K943, R1041, R1068, N1069, or H1073. In some cases, the Cas13 protein comprises one or more mutations of an amino acid corresponding to the following amino acids of *Prevotella buccae* Cas13b (PbCas13b): K183 or K193. In some cases, the Cas13 protein comprises in HEPN domain 1 one or more mutations of an amino acid corresponding to the following amino acids in HEPN domain 1 of *Prevotella buccae* Cas13b (PbCas13b): K183 or K193.

In some cases, the Cas13 protein comprises one or more mutations of an amino acid corresponding to the following amino acids of *Prevotella buccae* Cas13b (PbCas13b): R53, Y164, K943, or R1041. In some cases, the Cas13 protein comprises in a HEPN domain one or more mutations of an amino acid corresponding to the following amino acids in a HEPN domain of *Prevotella buccae* Cas13b (PbCas13b): R53, Y164, K943, or R1041. In some cases, the Cas13 protein comprises one or more mutations of an amino acid corresponding to the following amino acids of *Prevotella buccae* Cas13b (PbCas13b): R53, K943, or R1041; preferably R53A, R53K, R53D, or R53E; K943A, K943R, K943D, or K943E; or R1041A, R1041K, R1041D, or R1041E.

In some cases, the Cas13 protein comprises in a HEPN domain one or more mutations of an amino acid corresponding to the following amino acids in a HEPN domain of *Prevotella buccae* Cas13b (PbCas13b): R53, K943, or R1041; preferably R53A, R53K, R53D, or R53E; K943A, K943R, K943D, or K943E; or R1041A, R1041K, R1041D, or R1041E.

In some cases, the Cas13 protein comprises a mutation of an amino acid corresponding to amino acid Y164 of *Prevotella buccae* Cas13b (PbCas13b), preferably Y164A, Y164F, or Y164W. In some cases, the Cas13 protein comprises HEPN domain 1 a mutations of an amino acid corresponding to amino acid Y164 HEPN domain 1 of *Prevotella buccae* Cas13b (PbCas13b), preferably Y164A, Y164F, or Y164W. In some cases, the Cas13 protein comprises one or more mutations of an amino acid corresponding to the following amino acids of *Prevotella buccae* Cas13b (PbCas13b): T405, H407, K457, D434, K431, R402, K393, R482, N480, D396, E397, D398, or E399.

In some cases, the Cas13 protein comprises in the LID domain one or more mutations of an amino acid corresponding to the following amino acids in the LID domain of *Prevotella buccae* Cas13b (PbCas13b): T405, H407, K457, D434, K431, R402, K393, R482, N480, D396, E397, D398, or E399. In some cases, the Cas13 protein comprises a mutation of an amino acid corresponding to amino acid H407 of *Prevotella buccae* Cas13b (PbCas13b), preferably H407Y, H407W, or H407F. In some cases, the Cas13 protein comprises one or more mutations of an amino acid corresponding to the following amino acids of *Prevotella buccae* Cas13b (PbCas13b): R402, K393, R482, N480, D396, E397, D398, or E399. In some cases, the Cas13 protein comprises in the LID domain one or more mutations of an amino acid corresponding to the following amino acids in the LID domain of *Prevotella buccae* Cas13b (PbCas13b): R402, K393, R482, N480, D396, E397, D398, or E399. In some cases, the Cas13 protein comprises one or more mutations of an amino acid corresponding to the following amino acids of *Prevotella buccae* Cas13b (PbCas13b): K457, D434, or K431. In some cases, the Cas13 protein comprises in the LID domain one or more mutations of an amino acid corresponding to the following amino acids in the LID domain of *Prevotella buccae* Cas13b (PbCas13b): K457, D434, or K431.

In some cases, the Cas13 protein comprises one or more mutations of an amino acid corresponding to the following amino acids of *Prevotella buccae* Cas13b (PbCas13b): H500, K570, K590, N634, R638, N652, N653, K655, S658, K741, K744, N756, S757, R762, R791, K846, K857, K870, R877, R600, K607, K612, R614, K617, K826, K828, K829, R824, R830, Q831, K835, K836, R838, R618, Q646, N647, N653, or N652. In some cases, the Cas13 protein comprises in a helical domain one or more mutations of an amino acid corresponding to the following amino acids in a helical domain of *Prevotella buccae* Cas13b (PbCas13b): H500, K570, K590, N634, R638, N652, N653, K655, S658, K741, K744, N756, S757, R762, R791, K846, K857, K870, R877, R600, K607, K612, R614, K617, K826, K828, K829, R824, R830, Q831, K835, K836, R838, R618, Q646, N647, N653, or N652. In some cases, the Cas13 protein comprises one or more mutations of an amino acid corresponding to the following amino acids of *Prevotella buccae* Cas13b (PbCas13b): H500, K570, N756, S757, R762, R791, K846, K857, K870, R877, K826, K828, K829, R824, R830, Q831, K835, K836, or R838. In some cases, the Cas13 protein comprises in helical domain 1 one or more mutations of an amino acid corresponding to the following amino acids in helical domain 1 of *Prevotella buccae* Cas13b (PbCas13b): H500, K570, N756, S757, R762, R791, K846, K857, K870, R877, K826, K828, K829, R824, R830, Q831, K835, K836, or R838.

In some cases, the Cas13 protein comprises one or more mutations of an amino acid corresponding to the following amino acids of *Prevotella buccae* Cas13b (PbCas13b): H500, K570, N756, S757, R762, or R791. In some cases, the Cas13 protein comprises in helical domain 1 one or more mutations of an amino acid corresponding to the following amino acids in helical domain 1 of *Prevotella buccae* Cas13b (PbCas13b): H500, K570, N756, S757, R762, or R791. In some cases, the Cas13 protein comprises one or more mutations of an amino acid corresponding to the following amino acids of *Prevotella buccae* Cas13b (PbCas13b): K846, K857, K870, R877, K826, K828, K829, R824, R830, Q831, K835, K836, or R838. In some cases, the Cas13 protein comprises in the helical bridge domain one or more mutations of an amino acid corresponding to the following amino acids in the helical bridge domain of *Prevotella buccae* Cas13b (PbCas13b): K846, K857, K870, R877, K826, K828, K829, R824, R830, Q831, K835, K836, or R838. In some cases, the Cas13 protein comprises one or more mutations of an amino acid corresponding to the following amino acids of *Prevotella buccae* Cas13b (PbCas13b): H500 or K570. In some cases, the Cas13 protein comprises in helical domain 1-2 one or more mutations of an amino acid corresponding to the following amino acids in helical domain 1-2 of *Prevotella buccae* Cas13b (PbCas13b): H500 or K570.

In some cases, the Cas13 protein comprises one or more mutations of an amino acid corresponding to the following amino acids of *Prevotella buccae* Cas13b (PbCas13b): N756, S757, R762, R791, K846, K857, K870, R877, K826, K828, K829, R824, R830, Q831, K835, K836, or R838. In some cases, the Cas13 protein comprises in helical domain 1-3 one or more mutations of an amino acid corresponding to the following amino acids in helical domain 1-3 of *Prevotella buccae* Cas13b (PbCas13b): N756, S757, R762, R791, K846, K857, K870, R877, K826, K828, K829, R824, R830, Q831, K835, K836, or R838. In some cases, the Cas13 protein comprises one or more mutations of an amino acid corresponding to the following amino acids of *Prevotella buccae* Cas13b (PbCas13b): N756, S757, R762, or R791. In some cases, the Cas13 protein comprises in helical domain 1-3 one or more mutations of an amino acid corresponding to the following amino acids in helical domain 1-3 of *Prevotella buccae* Cas13b (PbCas13b): N756, S757, R762, or R791. In some cases, the Cas13 protein comprises one or more mutations of an amino acid corresponding to the following amino acids of *Prevotella buccae* Cas13b (PbCas13b): N756, S757, R762, R791, K846, K857, K870, or R877. In some cases, the Cas13 protein comprises in helical domain 1-3 one or more mutations of an amino acid corresponding to the following amino acids in helical domain 1-3 of *Prevotella buccae* Cas13b (PbCas13b): N756, S757, R762, R791, K846, K857, K870, or R877.

In some cases, the Cas13 protein comprises one or more mutations of an amino acid corresponding to the following amino acids of *Prevotella buccae* Cas13b (PbCas13b): K826, K828, K829, R824, R830, Q831, K835, K836, or R838. In some cases, the Cas13 protein comprises in helical domain 1-3 one or more mutations of an amino acid corresponding to the following amino acids in helical domain 1-3 of *Prevotella buccae* Cas13b (PbCas13b): K826, K828, K829, R824, R830, Q831, K835, K836, or R838.

In some cases, the Cas13 protein comprises one or more mutations of an amino acid corresponding to the following amino acids of *Prevotella buccae* Cas13b (PbCas13b): K590, N634, R638, N652, N653, K655, S658, K741, K744, R600, K607, K612, R614, K617, R618, Q646, N647, N653, or N652. In some cases, the Cas13 protein comprises in helical domain 2 one or more mutations of an amino acid corresponding to the following amino acids in helical domain 2 of *Prevotella buccae* Cas13b (PbCas13b): K590, N634, R638, N652, N653, K655, S658, K741, K744, R600, K607, K612, R614, K617, R618, Q646, N647, N653, or N652. In some cases, the Cas13 protein comprises one or more mutations of an amino acid corresponding to the following amino acids of *Prevotella buccae* Cas13b (PbCas13b): Q646 or N647. In some cases, the Cas13 protein comprises in helical domain 2 one or more mutations of an amino acid corresponding to the following amino acids in helical domain 2 of *Prevotella buccae* Cas13b (PbCas13b): Q646 or N647. In some cases, the Cas13 protein comprises one or more mutations of an amino acid corresponding to the following amino acids of *Prevotella buccae* Cas13b (PbCas13b): N653 or N652. In some cases, the Cas13 protein comprises in helical domain 2 one or more mutations of an amino acid corresponding to the following amino acids in helical domain 2 of *Prevotella buccae* Cas13b (PbCas13b): N653 or N652. In some cases, the Cas13 protein comprises one or more mutations of an amino acid corresponding to the following amino acids of *Prevotella buccae* Cas13b (PbCas13b): K590, N634, R638, N652, N653, K655, S658, K741, or K744. In some cases, the Cas13 protein comprises in helical domain 2 one or more mutations of an amino acid corresponding to the following amino acids in helical domain 2 of *Prevotella buccae* Cas13b (PbCas13b): K590, N634, R638, N652, N653, K655, S658, K741, or K744. In some cases, the Cas13 protein comprises one or more mutations of an amino acid corresponding to the following amino acids of *Prevotella buccae* Cas13b (PbCas13b): R600, K607, K612, R614, K617, or R618. In some cases, the Cas13 protein comprises in helical domain 2 one or more mutations of an amino acid corresponding to the following amino acids in helical domain 2 of *Prevotella buccae* Cas13b (PbCas13b): R600, K607, K612, R614, K617, or R618. In some cases, the Cas13 protein comprises one or more mutations of an amino acid corresponding to the following amino acids of *Prevotella buccae* Cas13b (PbCas13b): R285, R287, K292, E296, N297, or K294. In some cases, the Cas13 protein comprises in the IDL domain one or more mutations of an amino acid corresponding to the following amino acids in the IDL domain of *Prevotella buccae* Cas13b (PbCas13b): R285, R287, K292, E296, N297, or K294. In some cases, the Cas13 protein comprises one or more mutations of an amino acid corresponding to the following amino acids of *Prevotella buccae* Cas13b (PbCas13b): R285, K292, E296, or N297. In some cases, the Cas13 protein comprises in the IDL domain one or more mutations of an amino acid corresponding to the following amino acids in the IDL domain of *Prevotella buccae* Cas13b (PbCas13b): R285, K292, E296, or N297.

In some cases, the Cas13 protein comprises one or more mutations of an amino acid corresponding to the following amino acids of *Prevotella buccae* Cas13b (PbCas13b): T405, H500, K570, K590, N634, R638, N652, N653, K655, S658, K741, K744, N756, S757, R762, R791, K846, K857, K870, R877, K183, K193, R600, K607, K612, R614, K617, K826, K828, K829, R824, R830, Q831, K835, K836, R838, R618, D434, K431, R285, R287, K292, E296, N297, Q646, N647, or K294. In some cases, the Cas13 protein comprises one or more mutations of an amino acid corresponding to the following amino acids of *Prevotella buccae* Cas13b (PbCas13b): R402, K393, N653, N652, R482, N480, D396, E397, D398, or E399. In some cases, the Cas13 protein comprises one or more mutations of an amino acid corresponding to the following amino acids of *Prevotella buccae* Cas13b (PbCas13b): R53, K655, R762, or R1041; preferably R53A or R53D; K655A; R762A; or R1041E or R1041D. In some cases, the Cas13 protein comprises one or more mutations of an amino acid corresponding to the following amino acids of *Prevotella buccae* Cas13b (PbCas13b): N297, E296, K292, or R285; preferably N297A, E296A, K292A, or R285A. In some cases, the Cas13 protein comprises in (e.g., the central channel of) the IDL domain one or more mutations of an amino acid corresponding to the following amino acids in (e.g., the central channel of) the IDL domain of *Prevotella buccae* Cas13b (PbCas13b): N297, E296, K292, or R285; preferably N297A, E296A, K292A, or R285A. In some cases, the Cas13 protein comprises one or more mutations of an amino acid corresponding to the following amino acids of *Prevotella buccae* Cas13b (PbCas13b): Q831, K836, R838, N652, N653, R830, K655 or R762; preferably Q831A, K836A, R838A, N652A, N653A, R830A, K655A, or R762A.

In some cases, the Cas13 protein comprises one or more mutations of an amino acid corresponding to the following amino acids of *Prevotella buccae* Cas13b (PbCas13b): N652, N653, R830, K655 or R762; preferably N652A, N653A, R830A, K655A, or R762A. In some cases, the Cas13 protein comprises one or more mutations of an amino acid corresponding to the following amino acids of *Prevotella buccae* Cas13b (PbCas13b): K655 or R762; preferably K655A or R762A. In some cases, the Cas13 protein comprises in a helical domain one or more mutations of an amino acid corresponding to the following amino acids in a helical domain of *Prevotella buccae* Cas13b (PbCas13b): Q831, K836, R838, N652, N653, R830, K655 or R762; preferably Q831A, K836A, R838A, N652A, N653A, R830A, K655A, or R762A. In some cases, the Cas13 protein comprises a helical domain one or more mutations of an amino acid corresponding to the following amino acids a helical domain of *Prevotella buccae* Cas13b (PbCas13b): N652, N653, R830, K655 or R762; preferably N652A, N653A, R830A, K655A, or R762A.

In some cases, the Cas13 protein comprises in helical domain 2 one or more mutations of an amino acid corresponding to the following amino acids in helical domain 2 of *Prevotella buccae* Cas13b (PbCas13b): K655 or R762; preferably K655A or R762A. In some cases, the Cas13 protein comprises one or more mutations of an amino acid corresponding to the following amino acids of *Prevotella buccae* Cas13b (PbCas13b): R614, K607, K193, K183 or R600; preferably R614A, K607A, K193A, K183A or R600A. In some cases, the Cas13 protein comprises in the trans-subunit loop of helical domain 2 one or more mutations of an amino acid corresponding to the following amino acids in the trans-subunit loop of helical domain 2 of *Prevotella buccae* Cas13b (PbCas13b): Q646 or N647; preferably Q646A or N647A. In some cases, the Cas13 protein comprises one or more mutations of an amino acid corresponding to the following amino acids of *Prevotella buccae* Cas13b (PbCas13b): R53 or R1041; preferably R53A or R53D, or R1041E or R1041D. In some cases, the Cas13 protein comprises in a HEPN domain one or more mutations of an amino acid corresponding to the following amino acids in a HEPN domain of *Prevotella buccae* Cas13b (PbCas13b): R53 or R1041; preferably R53A or R53D, or R1041E or R1041D. In some cases, the Cas13 protein comprises one or more mutations of an amino acid corresponding to the following amino acids of *Prevotella buccae* Cas13b (PbCas13b): K457, D397, E398, D399, E400, T405, H407 or D434; preferably D397A, E398A, D399A, E400A, T405A, H407A, H407W, H407Y, H407F or D434A. In some cases, the Cas13 protein comprises in the LID domain one or more mutations of an amino acid corresponding to the following amino acids in the LID domain of *Prevotella buccae* Cas13b (PbCas13b): K457, D397, E398, D399, E400, T405, H407 or D434; preferably D397A, E398A, D399A, E400A, T405A, H407A, H407W, H407Y, H407F or D434A.

In some cases, the Cas13 protein comprises a mutation of an amino acid corresponding to amino acid T405 of *Prevotella buccae* Cas13b (PbCas13b). In some cases, the Cas13 protein comprises a mutation of an amino acid corresponding to amino acid H407 of *Prevotella buccae* Cas13b (PbCas13b). In some cases, the Cas13 protein comprises a mutation of an amino acid corresponding to amino acid K457 of *Prevotella buccae* Cas13b (PbCas13b). In some cases, the Cas13 protein comprises a mutation of an amino acid corresponding to amino acid H500 of *Prevotella buccae* Cas13b (PbCas13b). In some cases, the Cas13 protein comprises a mutation of an amino acid corresponding to amino acid K570 of *Prevotella buccae* Cas13b (PbCas13b). In some cases, the Cas13 protein comprises a mutation of an amino acid corresponding to amino acid K590 of *Prevotella buccae* Cas13b (PbCas13b). In some cases, the Cas13 protein comprises a mutation of an amino acid corresponding to amino acid N634 of *Prevotella buccae* Cas13b (PbCas13b). In some cases, the Cas13 protein comprises a mutation of an amino acid corresponding to amino acid R638 of *Prevotella buccae* Cas13b (PbCas13b). In some cases, the Cas13 protein comprises a mutation of an amino acid corresponding to amino acid N652 of *Prevotella buccae* Cas13b (PbCas13b). In some cases, the Cas13 protein comprises a mutation of an amino acid corresponding to amino acid N653 of *Prevotella buccae* Cas13b (PbCas13b). In some cases, the Cas13 protein comprises a mutation of an amino acid corresponding to amino acid K655 of *Prevotella buccae* Cas13b (PbCas13b). In some cases, the Cas13 protein comprises a mutation of an amino acid corresponding to amino acid S658 of *Prevotella buccae*

Cas13b (PbCas13b). In some cases, the Cas13 protein comprises a mutation of an amino acid corresponding to amino acid K741 of *Prevotella buccae* Cas13b (PbCas13b). In some cases, the Cas13 protein comprises a mutation of an amino acid corresponding to amino acid K744 of *Prevotella buccae* Cas13b (PbCas13b). In some cases, the Cas13 protein comprises a mutation of an amino acid corresponding to amino acid N756 of *Prevotella buccae* Cas13b (PbCas13b). In some cases, the Cas13 protein comprises a mutation of an amino acid corresponding to amino acid S757 of *Prevotella buccae* Cas13b (PbCas13b). In some cases, the Cas13 protein comprises a mutation of an amino acid corresponding to amino acid R762 of *Prevotella buccae* Cas13b (PbCas13b). In some cases, the Cas13 protein comprises a mutation of an amino acid corresponding to amino acid R791 of *Prevotella buccae* Cas13b (PbCas13b). In some cases, the Cas13 protein comprises a mutation of an amino acid corresponding to amino acid K846 of *Prevotella buccae* Cas13b (PbCas13b). In some cases, the Cas13 protein comprises a mutation of an amino acid corresponding to amino acid K857 of *Prevotella buccae* Cas13b (PbCas13b). In some cases, the Cas13 protein comprises a mutation of an amino acid corresponding to amino acid K870 of *Prevotella buccae* Cas13b (PbCas13b). In some cases, the Cas13 protein comprises a mutation of an amino acid corresponding to amino acid R877 of *Prevotella buccae* Cas13b (PbCas13b). In some cases, the Cas13 protein comprises a mutation of an amino acid corresponding to amino acid K183 of *Prevotella buccae* Cas13b (PbCas13b). In some cases, the Cas13 protein comprises a mutation of an amino acid corresponding to amino acid K193 of *Prevotella buccae* Cas13b (PbCas13b). In some cases, the Cas13 protein comprises a mutation of an amino acid corresponding to amino acid R600 of *Prevotella buccae* Cas13b (PbCas13b). In some cases, the Cas13 protein comprises a mutation of an amino acid corresponding to amino acid K607 of *Prevotella buccae* Cas13b (PbCas13b). In some cases, the Cas13 protein comprises a mutation of an amino acid corresponding to amino acid K612 of *Prevotella buccae* Cas13b (PbCas13b). In some cases, the Cas13 protein comprises a mutation of an amino acid corresponding to amino acid R614 of *Prevotella buccae* Cas13b (PbCas13b). In some cases, the Cas13 protein comprises a mutation of an amino acid corresponding to amino acid K617 of *Prevotella buccae* Cas13b (PbCas13b). In some cases, the Cas13 protein comprises a mutation of an amino acid corresponding to amino acid K826 of *Prevotella buccae* Cas13b (PbCas13b). In some cases, the Cas13 protein comprises a mutation of an amino acid corresponding to amino acid K828 of *Prevotella buccae* Cas13b (PbCas13b). In some cases, the Cas13 protein comprises a mutation of an amino acid corresponding to amino acid K829 of *Prevotella buccae* Cas13b (PbCas13b). In some cases, the Cas13 protein comprises a mutation of an amino acid corresponding to amino acid R824 of *Prevotella buccae* Cas13b (PbCas13b). In some cases, the Cas13 protein comprises a mutation of an amino acid corresponding to amino acid R830 of *Prevotella buccae* Cas13b (PbCas13b). In some cases, the Cas13 protein comprises a mutation of an amino acid corresponding to amino acid Q831 of *Prevotella buccae* Cas13b (PbCas13b).

In some cases, the Cas13 protein comprises a mutation of an amino acid corresponding to amino acid K835 of *Prevotella buccae* Cas13b (PbCas13b). In some cases, the Cas13 protein comprises a mutation of an amino acid corresponding to amino acid K836 of *Prevotella buccae* Cas13b (PbCas13b). In some cases, the Cas13 protein comprises a mutation of an amino acid corresponding to amino acid R838 of *Prevotella buccae* Cas13b (PbCas13b). In some cases, the Cas13 protein comprises a mutation of an amino acid corresponding to amino acid R618 of *Prevotella buccae* Cas13b (PbCas13b). In some cases, the Cas13 protein comprises a mutation of an amino acid corresponding to amino acid D434 of *Prevotella buccae* Cas13b (PbCas13b). In some cases, the Cas13 protein comprises a mutation of an amino acid corresponding to amino acid K431 of *Prevotella buccae* Cas13b (PbCas13b). In some cases, the Cas13 protein comprises a mutation of an amino acid corresponding to amino acid R53 of *Prevotella buccae* Cas13b (PbCas13b). In some cases, the Cas13 protein comprises a mutation of an amino acid corresponding to amino acid K943 of *Prevotella buccae* Cas13b (PbCas13b). In some cases, the Cas13 protein comprises a mutation of an amino acid corresponding to amino acid R1041 of *Prevotella buccae* Cas13b (PbCas13b). In some cases, the Cas13 protein comprises a mutation of an amino acid corresponding to amino acid Y164 of *Prevotella buccae* Cas13b (PbCas13b). In some cases, the Cas13 protein comprises a mutation of an amino acid corresponding to amino acid R285 of *Prevotella buccae* Cas13b (PbCas13b). In some cases, the Cas13 protein comprises a mutation of an amino acid corresponding to amino acid R287 of *Prevotella buccae* Cas13b (PbCas13b). In some cases, the Cas13 protein comprises a mutation of an amino acid corresponding to amino acid K292 of *Prevotella buccae* Cas13b (PbCas13b). In some cases, the Cas13 protein comprises a mutation of an amino acid corresponding to amino acid E296 of *Prevotella buccae* Cas13b (PbCas13b). In some cases, the Cas13 protein comprises a mutation of an amino acid corresponding to amino acid N297 of *Prevotella buccae* Cas13b (PbCas13b). In some cases, the Cas13 protein comprises a mutation of an amino acid corresponding to amino acid Q646 of *Prevotella buccae* Cas13b (PbCas13b).

In some cases, the Cas13 protein comprises a mutation of an amino acid corresponding to amino acid N647 of *Prevotella buccae* Cas13b (PbCas13b). In some cases, the Cas13 protein comprises a mutation of an amino acid corresponding to amino acid R402 of *Prevotella buccae* Cas13b (PbCas13b). In some cases, the Cas13 protein comprises a mutation of an amino acid corresponding to amino acid K393 of *Prevotella buccae* Cas13b (PbCas13b). In some cases, the Cas13 protein comprises a mutation of an amino acid corresponding to amino acid N653 of *Prevotella buccae* Cas13b (PbCas13b). In some cases, the Cas13 protein comprises a mutation of an amino acid corresponding to amino acid N652 of *Prevotella buccae* Cas13b (PbCas13b). In some cases, the Cas13 protein comprises a mutation of an amino acid corresponding to amino acid R482 of *Prevotella buccae* Cas13b (PbCas13b). In some cases, the Cas13 protein comprises a mutation of an amino acid corresponding to amino acid N480 of *Prevotella buccae* Cas13b (PbCas13b). In some cases, the Cas13 protein comprises a mutation of an amino acid corresponding to amino acid D396 of *Prevotella buccae* Cas13b (PbCas13b). In some cases, the Cas13 protein comprises a mutation of an amino acid corresponding to amino acid E397 of *Prevotella buccae* Cas13b (PbCas13b). In some cases, the Cas13 protein comprises a mutation of an amino acid corresponding to amino acid D398 of *Prevotella buccae* Cas13b (PbCas13b). In some cases, the Cas13 protein comprises a mutation of an amino acid corresponding to amino acid E399 of *Prevotella buccae* Cas13b (PbCas13b). In some cases, the Cas13 protein comprises a mutation of an amino acid corresponding to amino acid K294 of *Prevotella buccae*

Cas13b (PbCas13b). In some cases, the Cas13 protein comprises a mutation of an amino acid corresponding to amino acid E400 of *Prevotella buccae* Cas13b (PbCas13b). In some cases, the Cas13 protein comprises a mutation of an amino acid corresponding to amino acid R56 of *Prevotella buccae* Cas13b (PbCas13b). In some cases, the Cas13 protein comprises a mutation of an amino acid corresponding to amino acid N157 of *Prevotella buccae* Cas13b (PbCas13b). In some cases, the Cas13 protein comprises a mutation of an amino acid corresponding to amino acid H161 of *Prevotella buccae* Cas13b (PbCas13b). In some cases, the Cas13 protein comprises a mutation of an amino acid corresponding to amino acid H452 of *Prevotella buccae* Cas13b (PbCas13b). In some cases, the Cas13 protein comprises a mutation of an amino acid corresponding to amino acid N455 of *Prevotella buccae* Cas13b (PbCas13b). In some cases, the Cas13 protein comprises a mutation of an amino acid corresponding to amino acid K484 of *Prevotella buccae* Cas13b (PbCas13b). In some cases, the Cas13 protein comprises a mutation of an amino acid corresponding to amino acid N486 of *Prevotella buccae* Cas13b (PbCas13b). In some cases, the Cas13 protein comprises a mutation of an amino acid corresponding to amino acid G566 of *Prevotella buccae* Cas13b (PbCas13b). In some cases, the Cas13 protein comprises a mutation of an amino acid corresponding to amino acid H567 of *Prevotella buccae* Cas13b (PbCas13b). In some cases, the Cas13 protein comprises a mutation of an amino acid corresponding to amino acid A656 of *Prevotella buccae* Cas13b (PbCas13b). In some cases, the Cas13 protein comprises a mutation of an amino acid corresponding to amino acid V795 of *Prevotella buccae* Cas13b (PbCas13b). In some cases, the Cas13 protein comprises a mutation of an amino acid corresponding to amino acid A796 of *Prevotella buccae* Cas13b (PbCas13b). In some cases, the Cas13 protein comprises a mutation of an amino acid corresponding to amino acid W842 of *Prevotella buccae* Cas13b (PbCas13b). In some cases, the Cas13 protein comprises a mutation of an amino acid corresponding to amino acid K871 of *Prevotella buccae* Cas13b (PbCas13b). In some cases, the Cas13 protein comprises a mutation of an amino acid corresponding to amino acid E873 of *Prevotella buccae* Cas13b (PbCas13b). In some cases, the Cas13 protein comprises a mutation of an amino acid corresponding to amino acid R874 of *Prevotella buccae* Cas13b (PbCas13b). In some cases, the Cas13 protein comprises a mutation of an amino acid corresponding to amino acid R1068 of *Prevotella buccae* Cas13b (PbCas13b). In some cases, the Cas13 protein comprises a mutation of an amino acid corresponding to amino acid N1069 of *Prevotella buccae* Cas13b (PbCas13b). In some cases, the Cas13 protein comprises a mutation of an amino acid corresponding to amino acid H1073 of *Prevotella buccae* Cas13b (PbCas13b).

In some cases, the Cas13 protein comprises one or more mutations of an amino acid corresponding to the following amino acids of *Leptotrichia shahii* Cas13a (LshCas13a): R597, N598, H602, R1278, N1279, or H1283. The present disclosure also includes a mutated Cas13 protein comprising one or more mutations of an amino acid corresponding to the following amino acids of *Leptotrichia shahii* Cas13a (LshCas13a): R597, N598, H602, R1278, N1279, or H1283. In some cases, the Cas13 protein comprises in a HEPN domain one or more mutations of an amino acid corresponding to the following amino acids in a HEPN domain of *Leptotrichia shahii* Cas13a (LshCas13a): R597, N598, H602, R1278, N1279, or H1283. In some cases, the Cas13 protein comprises one or more mutations of an amino acid corresponding to the following amino acids of *Leptotrichia shahii* Cas13a (LshCas13a): R597, N598, or H602. In some cases, the Cas13 protein comprises in HEPN domain 1 one or more mutation of an amino acid corresponding to the following amino acids in HEPN domain 1 of *Leptotrichia shahii* Cas13a (LshCas13a): R597, N598, or H602. In some cases, the Cas13 protein comprises one or more mutations of an amino acid corresponding to the following amino acids of *Leptotrichia shahii* Cas13a (LshCas13a): R1278, N1279, or H1283. In some cases, the Cas13 protein comprises in HEPN domain 2 one or more mutations of an amino acid corresponding to the following amino acids in HEPN domain 2 of *Leptotrichia shahii* Cas13a (LshCas13a): R1278, N1279, or H1283. In some cases, the Cas13 protein comprises one or more mutations of an amino acid corresponding to the following amino acids of *Porphyromonas gulae* Cas13b (PguCas13b): R146, H151, R1116, or H1121. In some cases, the Cas13 protein comprises one or more mutations of an amino acid corresponding to the following amino acids of *Porphyromonas gulae* Cas13b (PguCas13b): R146, H151, R1116, or H1121. In some cases, the Cas13 protein comprises in a HEPN domain one or more mutations of an amino acid corresponding to the following amino acids in a HEPN domain of *Porphyromonas gulae* Cas13b (PguCas13b): R146, H151, R1116, or H1121.

In some cases, the Cas13 protein comprises one or more mutations of an amino acid corresponding to the following amino acids of *Porphyromonas gulae* Cas13b (PguCas13b): R146 or H151. In some cases, the Cas13 protein comprises in HEPN domain 1 one or more mutations of an amino acid corresponding to the following amino acids in HEPN domain 1 of *Porphyromonas gulae* Cas13b (PguCas13b): R146 or H151. In some cases, the Cas13 protein comprises one or more mutations of an amino acid corresponding to the following amino acids of *Porphyromonas gulae* Cas13b (PguCas13b): R1116 or H1121. In some cases, the Cas13 protein comprises in HEPN domain 2 one or more mutations of an amino acid corresponding to the following amino acids in HEPN domain 2 of *Porphyromonas gulae* Cas13b (PguCas13b): R1116 or H1121. In some cases, the Cas13 protein comprises one or more mutations of an amino acid corresponding to the following amino acids of *Prevotella* sp. P5-125 Cas13b (PspCas13b): H133 or H1058. The present disclosure also provides a mutated Cas13 protein comprising one or more mutations of an amino acid corresponding to the following amino acids of *Prevotella* sp. P5-125 Cas13b (PspCas13b): H133 or H1058. In some cases, the Cas13 protein comprises in a HEPN domain one or more mutations of an amino acid corresponding to the following amino acids in a HEPN domain of *Prevotella* sp. P5-125 Cas13b (PspCas13b): H133 or H1058.

In some cases, the Cas13 protein comprises a mutation of an amino acid corresponding to amino acid H133 of *Prevotella* sp. P5-125 Cas13b (PspCas13b). In some cases, the Cas13 protein comprises in HEPN domain 1 a mutation of an amino acid corresponding to amino acid H133 in HEPN domain 1 of *Prevotella* sp. P5-125 Cas13b (PspCas13b). In some cases, the Cas13 protein comprises a mutation of an amino acid corresponding to amino acid H1058 of *Prevotella* sp. P5-125 Cas13b (PspCas13b). In some cases, the Cas13 protein comprises in HEPN domain 2 a mutation of an amino acid corresponding to the amino acid H1058 in HEPN domain 2 of *Prevotella* sp. P5-125 Cas13b (PspCas13b).

The CRISPR-Cas protein herein may comprise one or more amino acids mutated. In some embodiments, the amino acid is mutated to A, P, or V, preferably A. In some 9embodiments, the amino acid is mutated to a hydrophobic amino acid. In some embodiments, the amino acid is mutated to an aromatic amino acid. In some embodiments, the amino acid is mutated to a charged amino acid. In some embodiments, the amino acid is mutated to a positively charged amino acid. In some embodiments, the amino acid is mutated to a negatively charged amino acid. In some embodiments, the amino acid is mutated to a polar amino acid. In some embodiments, the amino acid is mutated to an aliphatic amino acid.

The present disclosure also provides for methods of altering activity of CRISPR-Cas proteins. In some examples, such methods comprise identifying one or more candidate amino acids in the Cas13 protein based on a three-dimensional structure of at least a portion of the Cas 13 protein, wherein the one or more candidate amino acids interact with a guide RNA that forms a complex with the Cas13 protein, or are in a HEPN active site, an inter-domain linker domain, or a bridge helix domain of the Cas13 protein; and mutating the one or more candidate amino acids thereby generating a mutated Cas13 protein, wherein activity the mutated Cas13 protein is different than the Cas13 protein.

Destabilized Cas13 and Fusion Proteins

In certain embodiments, the effector protein according to the invention as described herein is associated with or fused to a destabilization domain (DD). In some embodiments, the DD is ER50. A corresponding stabilizing ligand for this DD is, in some embodiments, 4HT. As such, in some embodiments, one of the at least one DDs is ER50 and a stabilizing ligand therefor is 4HT or CMP8. In some embodiments, the DD is DHFR50. A corresponding stabilizing ligand for this DD is, in some embodiments, TMP. As such, in some embodiments, one of the at least one DDs is DHFR50 and a stabilizing ligand therefor is TMP. In some embodiments, the DD is ER50. A corresponding stabilizing ligand for this DD is, in some embodiments, CMP8. CMP8 may therefore be an alternative stabilizing ligand to 4HT in the ER50 system. While it may be possible that CMP8 and 4HT can/should be used in a competitive matter, some cell types may be more susceptible to one or the other of these two ligands, and from this disclosure and the knowledge in the art the skilled person can use CMP8 and/or 4HT.

In some embodiments, one or two DDs may be fused to the N-terminal end of the Cas13 with one or two DDs fused to the C-terminal of the Cas13. In some embodiments, the at least two DDs are associated with the Cas13 and the DDs are the same DD, i.e. the DDs are homologous. Thus, both (or two or more) of the DDs could be ER50 DDs. This is preferred in some embodiments. Alternatively, both (or two or more) of the DDs could be DHFR50 DDs. This is also preferred in some embodiments. In some embodiments, the at least two DDs are associated with the Cas13 and the DDs are different DDs, i.e. the DDs are heterologous. Thus, one of the DDS could be ER50 while one or more of the DDs or any other DDs could be DHFR50. Having two or more DDs which are heterologous may be advantageous as it would provide a greater level of degradation control. A tandem fusion of more than one DD at the N or C-term may enhance degradation; and such a tandem fusion can be, for example ER50-ER50-Cas13 or DHFR-DHFR-Cas13 It is envisaged that high levels of degradation would occur in the absence of either stabilizing ligand, intermediate levels of degradation would occur in the absence of one stabilizing ligand and the presence of the other (or another) stabilizing ligand, while low levels of degradation would occur in the presence of both (or two of more) of the stabilizing ligands. Control may also be imparted by having an N-terminal ER50 DD and a C-terminal DHFR50 DD.

In some embodiments, the fusion of the Cas13 with the DD comprises a linker between the DD and the Cas13. In some embodiments, the linker is a GlySer linker. In some embodiments, the DD-Cas13 further comprises at least one Nuclear Export Signal (NES). In some embodiments, the DD-Cas13 comprises two or more NESs. In some embodiments, the DD-Cas13 comprises at least one Nuclear Localization Signal (NLS). This may be in addition to an NES. In some embodiments, the Cas13 comprises or consists essentially of or consists of a localization (nuclear import or export) signal as, or as part of, the linker between the Cas13 and the DD. HA or Flag tags are also within the ambit of the invention as linkers. Applicants use NLS and/or NES as linker and also use Glycine Serine linkers as short as GS up to (GGGGS)3.

Destabilizing domains have general utility to confer instability to a wide range of proteins; see, e.g., Miyazaki, J Am Chem Soc. Mar. 7, 2012; 134(9): 3942-3945, incorporated herein by reference. CMP8 or 4-hydroxytamoxifen can be destabilizing domains. More generally, A temperature-sensitive mutant of mammalian DHFR (DHFRts), a destabilizing residue by the N-end rule, was found to be stable at a permissive temperature but unstable at 37° C. The addition of methotrexate, a high-affinity ligand for mammalian DHFR, to cells expressing DHFRts inhibited degradation of the protein partially. This was an important demonstration that a small molecule ligand can stabilize a protein otherwise targeted for degradation in cells. A rapamycin derivative was used to stabilize an unstable mutant of the FRB domain of mTOR (FRB*) and restore the function of the fused kinase, GSK-3β.6,7 This system demonstrated that ligand-dependent stability represented an attractive strategy to regulate the function of a specific protein in a complex biological environment. A system to control protein activity can involve the DD becoming functional when the ubiquitin complementation occurs by rapamycin induced dimerization of FK506-binding protein and FKBP12. Mutants of human FKBP12 or ecDHFR protein can be engineered to be metabolically unstable in the absence of their high-affinity ligands, Shield-1 or trimethoprim (TMP), respectively. These mutants are some of the possible destabilizing domains (DDs) useful in the practice of the invention and instability of a DD as a fusion with a Cas13 confers to the Cas13 degradation of the entire fusion protein by the proteasome. Shield-1 and TMP bind to and stabilize the DD in a dose-dependent manner. The estrogen receptor ligand binding domain (ERLBD, residues 305-549 of ERS1) can also be engineered as a destabilizing domain. Since the estrogen receptor signaling pathway is involved in a variety of diseases such as breast cancer, the pathway has been widely studied and numerous agonist and antagonists of estrogen receptor have been developed. Thus, compatible pairs of ERLBD and drugs are known. There are ligands that bind to mutant but not wild-type forms of the ERLBD. By using one of these mutant domains encoding three mutations (L384M, M421G, G521R)12, it is possible to regulate the stability of an ERLBD-derived DD using a ligand that does not perturb endogenous estrogen-sensitive networks. An additional mutation (Y537S) can be introduced to further destabilize the ERLBD and to configure it as a potential DD candidate. This tetra-mutant is an advantageous DD development. The mutant ERLBD can be fused to a Cas13 and its stability can be regulated or perturbed using a ligand, whereby the Cas13 has a DD. Another DD can be a 12-kDa (107-amino-acid) tag based on a mutated FKBP protein, stabilized by Shieldi ligand; see, e.g., Nature Methods 5, (2008). For instance a DD can be a modified FK506 binding protein 12 (FKBP12) that binds to and is reversibly stabilized by a synthetic, biologically inert small molecule, Shield-1; see, e.g., Banaszynski L A, Chen L C, Maynard-Smith L A, Ooi A G, Wandless T J. A rapid, reversible, and tunable method to regulate protein function in living cells using synthetic small molecules. Cell. 2006; 126:995-1004; Banaszynski L A, Sellmyer M A, Contag C H, Wandless T J, Thorne S H. Chemical control of protein stability and function in living mice. Nat Med. 2008; 14:1123-1127; Maynard-Smith L A, Chen L C, Banaszynski L A, Ooi A G, Wandless T J. A directed approach for engineering conditional protein stability using biologically silent small molecules. The Journal of biological chemistry. 2007; 282: 24866-24872; and Rodriguez, Chem Biol. Mar. 23, 2012; 19(3): 391-398—all of which are incorporated herein by reference and may be employed in the practice of the invention in selected a DD to associate with a Cas13 in the practice of this invention. As can be seen, the knowledge in the art includes a number of DDs, and the DD can be associated with, e.g., fused to, advantageously with a linker, to a Cas13, whereby the DD can be stabilized in the presence of a ligand and when there is the absence thereof the DD can become destabilized, whereby the Cas13 is entirely destabilized, or the DD can be stabilized in the absence of a ligand and when the ligand is present the DD can become destabilized; the DD allows the Cas13 and hence the CRISPR-Cas13 complex or system to be regulated or controlled—turned on or off so to speak, to thereby provide means for regulation or control of the system, e.g., in an in vivo or in vitro environment. For instance, when a protein of interest is expressed as a fusion with the DD tag, it is destabilized and rapidly degraded in the cell, e.g., by proteasomes. Thus, absence of stabilizing ligand leads to a D associated Cas being degraded. When a new DD is fused to a protein of interest, its instability is conferred to the protein of interest, resulting in the rapid degradation of the entire fusion protein. Peak activity for Cas is sometimes beneficial to reduce off-target effects. Thus, short bursts of high activity are preferred. The present invention is able to provide such peaks. In some senses the system is inducible. In some other senses, the system repressed in the absence of stabilizing ligand and de-repressed in the presence of stabilizing ligand.

Dead Cas Proteins

In certain embodiments, the effector protein herein is a catalytically inactive or dead Cas protein. In some cases, the effector protein (CRISPR enzyme; Cas13; effector protein) according to the invention as described herein is a catalytically inactive or dead Cas13 effector protein (dCas13). In some cases, a dead Cas protein, e.g., a dead Cas13 protein has nickase activity. In some embodiments, the dCas13 effector comprises mutations in the nuclease domain. In some embodiments, the dCas13 effector protein has been truncated. In some cases, the dead Cas proteins may be fused with a deaminase herein, e.g., an adenosine deaminase.

To reduce the size of a fusion protein of the Cas13 effector and the one or more functional domains, the C-terminus of the Cas13 effector can be truncated while still maintaining its RNA binding function. For example, at least 20 amino acids, at least 40 amino acids, at least 50 amino acids, at least 60 amino acids, at least 80 amino acids, at least 100 amino acids, at least 120 amino acids, at least 140 amino acids, at least 150 amino acids, at least 160 amino acids, at least 180 amino acids, at least 200 amino acids, at least 220 amino acids, at least 240 amino acids, at least 250 amino acids, at least 260 amino acids, or at least 300 amino acids, or at least 350 amino acids, or up to 120 amino acids, or up to 140 amino acids, or up to 160 amino acids, or up to 180 amino acids, or up to 200 amino acids, or up to 250 amino acids, or up to 300 amino acids, or up to 350 amino acids, or up to 400 amino acids, may be truncated at the C-terminus of the Cas13 effector. Specific examples of Cas13 truncations include C-terminal Δ984-1090, C-terminal Δ1026-1090, and C-terminal Δ1053-1090, C-terminal Δ934-1090, C-terminal Δ884-1090, C-terminal Δ834-1090, C-terminal Δ784-1090, and C-terminal Δ734-1090, wherein amino acid positions correspond to amino acid positions of *Prevotella* sp. P5-125 Cas13b protein. The skilled person will understand that similar truncations can be designed for other Cas13b orthologues, or other Cas13 types or subtypes, such as Cas13a, Cas13c, or Cas13d. In some cases, the truncated Cas13b is encoded by nt 1-984 of *Prevotella* sp. P5-125 Cas13b or the corresponding nt of a Cas13b orthologue or homologue. Examples of Cas13 truncations also include C-terminal Δ795-1095, wherein amino acid positions correspond to amino acid positions of *Riemerella anatipestifer* Cas13b protein. Examples of Cas13 truncations further include C-terminal Δ875-1175, C-terminal Δ895-1175, C-terminal Δ915-1175, C-terminal Δ935-1175, C-terminal Δ955-1175, C-terminal Δ975-1175, C-terminal Δ995-1175, C-terminal Δ1015-1175, C-terminal Δ1035-1175, C-terminal Δ1055-1175, C-terminal Δ1075-1175, C-terminal Δ1095-1175, C-terminal Δ1115-1175, C-terminal Δ1135-1175, C-terminal Δ1155-1175, wherein amino acid positions correspond to amino acid positions of *Porphyromonas gulae* Cas13b protein.

In some embodiments, the N-terminus of the Cas13 effector protein may be truncated. For example, at least 20 amino acids, at least 40 amino acids, at least 50 amino acids, at least 60 amino acids, at least 80 amino acids, at least 100 amino acids, at least 120 amino acids, at least 140 amino acids, at least 150 amino acids, at least 160 amino acids, at least 180 amino acids, at least 200 amino acids, at least 220 amino acids, at least 240 amino acids, at least 250 amino acids, at least 260 amino acids, or at least 300 amino acids, or at least 350 amino acids, or up to 120 amino acids, or up to 140 amino acids, or up to 160 amino acids, or up to 180 amino acids, or up to 200 amino acids, or up to 250 amino acids, or up to 300 amino acids, or up to 350 amino acids, or up to 400 amino acids, may be truncated at the N-terminus of the Cas13 effector. Examples of Cas13 truncations include N-terminal Δ1-125, N-terminal Δ1-88, or N-terminal Δ1-72, wherein amino acid positions of the truncations correspond to amino acid positions of *Prevotella* sp. P5-125 Cas13b protein.

In some embodiments, both the N- and the C-termini of the Cas13 effector protein may be truncated. For example, at least 20 amino acids may be truncated at the C-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas13 effector. For example, at least 40 amino acids may be truncated at the C-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas13 effector. For example, at least 60 amino acids may be truncated at the C-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas13 effector. For example, at least 80 amino acids may be truncated at the C-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas13 effector. For example, at least 100 amino acids may be truncated at the C-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas13 effector. For example, at least 120 amino acids may be truncated at the C-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas13 effector. For example, at least 140 amino acids may be truncated at the C-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas13 effector. For example, at least 160 amino acids may be truncated at the C-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas13 effector. For example, at least 180 amino acids may be truncated at the C-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas13 effector. For example, at least 200 amino acids may be truncated at the C-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas13 effector. For example, at least 220 amino acids may be truncated at the C-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas13 effector. For example, at least 240 amino acids may be truncated at the C-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas13 effector. For example, at least 260 amino acids may be truncated at the C-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas13 effector. For example, at least 280 amino acids may be truncated at the C-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas13 effector. For example, at least 300 amino acids may be truncated at the C-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas13 effector. For example, at least 350 amino acids may be truncated at the C-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the N-terminus of the Cas13 effector. For example, at least 20 amino acids may be truncated at the N-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas13 effector. For example, at least 40 amino acids may be truncated at the N-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas13 effector. For example, at least 60 amino acids may be truncated at the N-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas13 effector. For example, at least 80 amino acids may be truncated at the N-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas13 effector. For example, at least 100 amino acids may be truncated at the N-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas13 effector. For example, at least 120 amino acids may be truncated at the N-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas13 effector. For example, at least 140 amino acids may be truncated at the N-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas13 effector. For example, at least 160 amino acids may be truncated at the N-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas13 effector. For example, at least 180 amino acids may be truncated at the N-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas13 effector. For example, at least 200 amino acids may be truncated at the N-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas13 effector. For example, at least 220 amino acids may be truncated at the N-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas13 effector. For example, at least 240 amino acids may be truncated at the N-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas13 effector. For example, at least 260 amino acids may be truncated at the N-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas13 effector. For example, at least 280 amino acids may be truncated at the N-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas13 effector. For example, at least 300 amino acids may be truncated at the N-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas13 effector. For example, at least 350 amino acids may be truncated at the N-terminus of the Cas13 effector, and at least 20 amino acids, at least 40 amino acids, at least 60 amino acids, at least 80 amino acids, at least 100 amino acids, at least 120 amino acids, at least 140 amino acids, at least 160 amino acids, at least 180 amino acids, at least 200 amino acids, at least 220 amino acids, at least 240 amino acids, at least 260 amino acids, at least 300 amino acids, or at least 350 amino acids may be truncated at the C-terminus of the Cas13 effector.

Split Proteins

It is noted that in this context, and more generally for the various applications as described herein, the use of a split version of the RNA targeting effector protein can be envisaged. Indeed, this may not only allow increased specificity but may also be advantageous for delivery. The Cas13 is split in the sense that the two parts of the Cas13 enzyme substantially comprise a functioning Cas13. Ideally, the split should always be so that the catalytic domain(s) are unaffected. That Cas13 may function as a nuclease or it may be a dead-Cas13 which is essentially an RNA-binding protein with very little or no catalytic activity, due to typically mutation(s) in its catalytic domains.

Each half of the split Cas13 may be fused to a dimerization partner. By means of example, and without limitation, employing rapamycin sensitive dimerization domains, allows to generate a chemically inducible split Cas13 for temporal control of Cas13 activity. Cas13 can thus be rendered chemically inducible by being split into two fragments and that rapamycin-sensitive dimerization domains may be used for controlled reassembly of the Cas13. The two parts of the split Cas13 can be thought of as the N' terminal part and the C' terminal part of the split Cas13. The fusion is typically at the split point of the Cas13. In other words, the C' terminal of the N' terminal part of the split Cas13 is fused to one of the dimer halves, whilst the N' terminal of the C' terminal part is fused to the other dimer half.

The Cas13 does not have to be split in the sense that the break is newly created. The split point is typically designed in silico and cloned into the constructs. Together, the two parts of the split Cas13, the N' terminal and C' terminal parts, form a full Cas13, comprising preferably at least 70% or more of the wildtype amino acids (or nucleotides encoding them), preferably at least 80% or more, preferably at least 90% or more, preferably at least 95% or more, and most preferably at least 99% or more of the wildtype amino acids (or nucleotides encoding them). Some trimming may be possible, and mutants are envisaged. Non-functional domains may be removed entirely. What is important is that the two parts may be brought together and that the desired Cas13 function is restored or reconstituted. The dimer may be a homodimer or a heterodimer.

In certain embodiments, the Cas13 effector as described herein may be used for mutation-specific, or allele-specific targeting, such as. for mutation-specific, or allele-specific knockdown.

The RNA targeting effector protein can moreover be fused to another functional RNase domain, such as a non-specific RNase or Argonaute 2, which acts in synergy to increase the RNase activity or to ensure further degradation of the message.

Modulating Cas13 Effector Proteins

The invention provides accessory proteins that modulate CRISPR protein function. In certain embodiments, the accessory protein modulates catalytic activity of a CRISPR protein. In an embodiment of the invention an accessory protein modulates targeted, or sequence specific, nuclease activity. In an embodiment of the invention, an accessory protein modulates collateral nuclease activity. In an embodiment of the invention, an accessory protein modulates binding to a target nucleic acid.

According to the invention, the nuclease activity to be modulated can be directed against nucleic acids comprising or consisting of RNA, including without limitation mRNA, miRNA, siRNA and nucleic acids comprising cleavable RNA linkages along with nucleotide analogs. In an embodiment of the invention, the nuclease activity to be modulated can be directed against nucleic acids comprising or consisting of DNA, including without limitation nucleic acids comprising cleavable DNA linkages and nucleic acid analogs.

In an embodiment of the invention, an accessory protein enhances an activity of a CRISPR protein. In certain such embodiments, the accessory protein comprises a HEPN domain and enhances RNA cleavage. In certain embodiments, the accessory protein inhibits an activity of a CRISPR protein. In certain such embodiments, the accessory protein comprises an inactivated HEPN domain or lacks an HEPN domain altogether.

According to the invention, naturally occurring accessory proteins of Type VI CRISPR systems comprise small proteins encoded at or near a CRISPR locus that function to modify an activity of a CRISPR protein. In general, a CRISPR locus can be identified as comprising a putative CRISPR array and/or encoding a putative CRISPR effector protein. In an embodiment, an effector protein can be from 800 to 2000 amino acids, or from 900 to 1800 amino acids, or from 950 to 1300 amino acids. In an embodiment, an accessory protein can be encoded within 25 kb, or within 20 kb or within 15 kb, or within 10 kb of a putative CRISPR effector protein or array, or from 2 kb to 10 kb from a putative CRISPR effector protein or array.

In an embodiment of the invention, an accessory protein is from 50 to 300 amino acids, or from 100 to 300 amino acids or from 150 to 250 amino acids or about 200 amino acids. Non-limiting examples of accessory proteins include the csx27 and csx28 proteins identified herein.

Identification and use of a CRISPR accessory protein of the invention is independent of CRISPR effector protein classification. Accessory proteins of the invention can be found in association with or engineered to function with a variety of CRISPR effector proteins. Examples of accessory proteins identified and used herein are representative of CRISPR effector proteins generally. It is understood that CRISPR effector protein classification may involve homology, feature location (e.g., location of REC domains, NUC domains, HEPN sequences), nucleic acid target (e.g. DNA or RNA), absence or presence of tracr RNA, location of guide/spacer sequence 5' or 3' of a direct repeat, or other criteria. In embodiments of the invention, accessory protein identification and use transcend such classifications.

In type VI CRISPR-Cas systems that target RNA, the Cas proteins usually comprise two conserved HEPN domains which are involved in RNA cleavage. In certain embodiments, the Cas protein processes crRNA to generate mature crRNA. The guide sequence of the crRNA recognizes target RNA with a complementary sequence and the Cas protein degrades the target strand. More particularly, in certain embodiments, upon target binding, the Cas protein undergoes a structural rearrangement that brings two HEPN domains together to form an active HEPN catalytic site and the target RNA is then cleaved. The location of the catalytic site near the surface of the Cas protein allows non-specific collateral ssRNA cleavage.

In certain embodiments, accessory proteins are instrumental in increasing or reducing target and/or collateral RNA cleavage. Without being bound by theory, an accessory protein that activates CRISPR activity (e.g., a csx28 protein or ortholog or variant comprising a HEPN domain) can be envisioned as capable of interacting with a Cas protein and combining its HEPN domain with a HEPN domain of the Cas protein to form an active HEPN catalytic site, whereas an inhibitory accessory protein (e.g. csx27 with lacks an HEPN domain) can be envisioned as capable of interacting with a Cas protein and reducing or blocking a conformation of the Cas protein that would bring together two HEPN domains.

According to the invention, in certain embodiments, enhancing activity of a Type VI Cas protein or complex thereof comprises contacting the Type VI Cas protein or complex thereof with an accessory protein from the same organism that activates the Cas protein. In other embodiments, enhancing activity of a Type VI Cas protein of complex thereof comprises contacting the Type VI Cas protein or complex thereof with an activator accessory protein from a different organism within the same subclass (e.g., Type VI-b). In other embodiments, enhancing activity of a Type VI Cas protein or complex thereof comprises contacting the Type VI Cas protein or complex thereof with an accessory protein not within the subclass (e.g., a Type VI Cas protein other than Type VI-b with a Type VI-b accessory protein or vice-versa).

According to the invention, in certain embodiments, repressing activity of a Type VI Cas protein or complex thereof comprises contacting the Type VI Cas protein or complex thereof with an accessory protein from the same organism that represses the Cas protein. In other embodiments, repressing activity of a Type VI Cas protein or complex thereof comprises contacting the Type VI Cas protein or complex thereof with a repressor accessory protein from a different organism within the same subclass (e.g., Type VI-b). In other embodiments, repressing activity of a Type VI Cas protein or complex thereof comprises contacting the Type VI Cas protein or complex thereof with a repressor accessory protein not within the subclass (e.g., a Type VI Cas protein other than Type VI-b with a Type VI-b repressor accessory protein or vice-versa).

In certain embodiments where the Type VI Cas protein and the Type VI accessory protein are from the same organism, the two proteins will function together in an engineered CRISPR system. In certain embodiments, it will be desirable to alter the function of the engineered CRISPR system, for example by modifying either or both of the proteins or their expression. In embodiments where the Type VI Cas protein and the Type VI accessory protein are from different organisms which may be within the same class or different classes, the proteins may function together in an engineered CRISPR system but it will often be desired or necessary to modify either or both of the proteins to function together.

Accordingly, in certain embodiments of the invention either or both of a Cas protein and an accessory protein may be modified to adjust aspects of protein-protein interactions between the Cas protein and accessory protein. In certain embodiments, either or both of a Cas protein and an accessory protein may be modified to adjust aspects of protein-nucleic acid interactions. Ways to adjust protein-protein interactions and protein-nucleic acid interaction include without limitation, fitting molecular surfaces, polar interactions, hydrogen bonds, and modulating van der Waals interactions. In certain embodiments, adjusting protein-protein interactions or protein-nucleic acid binding comprises increasing or decreasing binding interactions. In certain embodiments, adjusting protein-protein interactions or protein-nucleic acid binding comprises modifications that favor or disfavor a conformation of the protein or nucleic acid.

By "fitting", is meant determining including by automatic, or semi-automatic means, interactions between one or more atoms of a Cas13 protein (and optionally at least one atoms of a Cas13 accessory protein), or between one or more atoms of a Cas13 protein and one or more atoms of a nucleic acid, (or optionally between one or more atoms of a Cas13 accessory protein and a nucleic acid), and calculating the extent to which such interactions are stable. Interactions include attraction and repulsion, brought about by charge, steric considerations and the like.

The three-dimensional structure of Type VI CRISPR protein or complex thereof (and/or a Type VI CRISPR accessory protein or complex thereof in the context of Cas13b) provides in the context of the instant invention an additional tool for identifying additional mutations in orthologs of Cas13. The crystal structure can also be basis for the design of new and specific Cas13s (and optionally Cas13 accessory proteins). Various computer-based methods for fitting are described further. Binding interactions of Cas13s (and optionally accessory proteins), and nucleic acids can be examined through the use of computer modeling using a docking program. Docking programs are known; for example GRAM, DOCK or AUTODOCK (see Walters et al. Drug Discovery Today, vol. 3, no. 4 (1998), 160-178, and Dunbrack et al. Folding and Design 2 (1997), 27-42). This procedure can include computer fitting to ascertain how well the shape and the chemical structure of the binding partners. Computer-assisted, manual examination of the active site or binding site of a Type VI system may be performed. Programs such as GRID (P. Goodford, J. Med. Chem, 1985, 28, 849-57)—a program that determines probable interaction sites between molecules with various functional groups—may also be used to analyze the active site or binding site to predict partial structures of binding compounds. Computer programs can be employed to estimate the attraction, repulsion or steric hindrance of the two binding partners, e.g., components of a Type VI CRISPR system, or a nucleic acid molecule and a component of a Type VI CRISPR system.

Amino acid substitutions may be made on the basis of differences or similarities in amino acid properties (such as polarity, charge, solubility, hydrophobicity, hydrophilicity, and/or the amphipathic nature of the residues) and it is therefore useful to group amino acids together in functional groups. Amino acids may be grouped together based on the properties of their side chains alone. In comparing orthologs, there are likely to be residues conserved for structural or catalytic reasons. These sets may be described in the form of a Venn diagram (Livingstone C. D. and Barton G. J. (1993) "Protein sequence alignments: a strategy for the hierarchical analysis of residue conservation" Comput. Appl. Biosci. 9: 745-756) (Taylor W. R. (1986) "The classification of amino acid conservation" J. Theor. Biol. 119; 205-218). Conservative substitutions may be made, for example according to the table below which describes a generally accepted Venn diagram grouping of amino acids (see Table 7 below).

TABLE 7

| Set | | Sub-set | |
|---|---|---|---|
| Hydrophobic | F W Y H K M I L V A G C (SEQ ID NO: 240) | Aromatic<br>Aliphatic | F W Y H<br>I L V |
| Polar | W Y H K R E D C S T N Q (SEQ ID NO: 241) | Charged<br>Positively charged<br>Negatively charged | H K R E D<br>H K R<br>E D |
| Small | V C A G S P T N D (SEQ ID NO: 242) | Tiny | A G S |

In an engineered Cas13 system, modification may comprise modification of one or more amino acid residues of the Cas13 protein (and/or may comprise modification of one or more amino acid residues of the Cas13 accessory protein in the case of Cas13b).

In an engineered Cas13 system, modification may comprise modification of one or more amino acid residues located in a region which comprises residues which are positively charged in the unmodified Cas13 protein (and/or Cas13 accessory protein).

In an engineered Cas13 system, modification may comprise modification of one or more amino acid residues which are positively charged in the unmodified Cas13 protein (and/or Cas13 accessory protein).

In an engineered Cas13 system, modification may comprise modification of one or more amino acid residues which are not positively charged in the unmodified Cas13 protein (and/or Cas13 accessory protein).

The modification may comprise modification of one or more amino acid residues which are uncharged in the unmodified Cas13 protein (and/or Cas13 accessory protein).

The modification may comprise modification of one or more amino acid residues which are negatively charged in the unmodified Cas13 protein (and/or Cas13 accessory protein).

The modification may comprise modification of one or more amino acid residues which are hydrophobic in the unmodified Cas13 protein (and/or Cas13 accessory protein).

The modification may comprise modification of one or more amino acid residues which are polar in the unmodified Cas13 protein (and/or Cas13 accessory protein).

The modification may comprise substitution of a hydrophobic amino acid or polar amino acid with a charged amino acid, which can be a negatively charged or positively charged amino acid. The modification may comprise substitution of a negatively charged amino acid with a positively charged or polar or hydrophobic amino acid. The modification may comprise substitution of a positively charged amino acid with a negatively charged or polar or hydrophobic amino acid.

Embodiments of the invention include sequences (both polynucleotide or polypeptide) which may comprise homologous substitution (substitution and replacement are both used herein to mean the interchange of an existing amino acid residue or nucleotide, with an alternative residue or nucleotide) that may occur i.e., like-for-like substitution in the case of amino acids such as basic for basic, acidic for acidic, polar for polar, etc. Non-homologous substitution may also occur i.e., from one class of residue to another or alternatively involving the inclusion of unnatural amino acids such as ornithine (hereinafter referred to as Z), diaminobutyric acid ornithine (hereinafter referred to as B), norleucine ornithine (hereinafter referred to as O), pyriylalanine, thienylalanine, naphthylalanine and phenylglycine.

Variant amino acid sequences may include suitable spacer groups that may be inserted between any two amino acid residues of the sequence including alkyl groups such as methyl, ethyl or propyl groups in addition to amino acid spacers such as glycine or β-alanine residues. A further form of variation, which involves the presence of one or more amino acid residues in peptoid form, may be well understood by those skilled in the art. For the avoidance of doubt, "the peptoid form" is used to refer to variant amino acid residues wherein the α-carbon substituent group is on the residue's nitrogen atom rather than the α-carbon. Processes for preparing peptides in the peptoid form are known in the art, for example Simon R J et al., PNAS (1992) 89(20), 9367-9371 and Horwell D C, Trends Biotechnol. (1995) 13(4), 132-134.

Homology modelling: Corresponding residues in other Cas13 orthologs can be identified by the methods of Zhang et al., 2012 (Nature; 490(7421): 556-60) and Chen et al., 2015 (PLoS Comput Biol; 11(5): e1004248)—a computational protein-protein interaction (PPI) method to predict interactions mediated by domain-motif interfaces. PrePPI (Predicting PPI), a structure based PPI prediction method, combines structural evidence with non-structural evidence using a Bayesian statistical framework. The method involves taking a pair a query proteins and using structural alignment to identify structural representatives that correspond to either their experimentally determined structures or homology models. Structural alignment is further used to identify both close and remote structural neighbors by considering global and local geometric relationships. Whenever two neighbors of the structural representatives form a complex reported in the Protein Data Bank, this defines a template for modelling the interaction between the two query proteins. Models of a complex are created by superimposing the representative structures on their corresponding structural neighbor in the template. This approach is in Dey et al., 2013 (Prot Sci; 22: 359-66).

Collateral Activity

Collateral activity was recently leveraged for a highly sensitive and specific nucleic acid detection platform termed SHERLOCK that is useful for many clinical diagnoses (Gootenberg, J. S. et al. Nucleic acid detection with CRISPR-Cas13a/C2c2. Science 356, 438-442 (2017)).

According to the invention, engineered CRISPR-Cas systems are optimized for RNA endonuclease activity and can be expressed in mammalian cells and targeted to effectively knock down reporter molecules or transcripts in cells.

The collateral effect of engineered CRISPR-Cas with isothermal amplification provides a CRISPR-based diagnostic providing rapid DNA or RNA detection with high sensitivity and single-base mismatch specificity. The CRISPR-Cas-based molecular detection platform is used to detect specific strains of virus, distinguish pathogenic bacteria, genotype human DNA, and identify cell-free tumor DNA mutations. Furthermore, reaction reagents can be lyophilized for cold-chain independence and long-term storage, and readily reconstituted on paper for field applications.

The ability to rapidly detect nucleic acids with high sensitivity and single-base specificity on a portable platform may aid in disease diagnosis and monitoring, epidemiology, and general laboratory tasks. Although methods exist for detecting nucleic acids, they have trade-offs among sensitivity, specificity, simplicity, cost, and speed.

Microbial Clustered Regularly Interspaced Short Palindromic Repeats (CRISPR) and CRISPR-associated (CRISPR-Cas) adaptive immune systems contain programmable endonucleases that can be leveraged for CRISPR-based diagnostics (CRISPR-Dx). CRISPR-Cas can be reprogrammed with CRISPR RNAs (crRNAs) to provide a platform for specific DNA sensing. Upon recognition of its DNA target, activated CRISPR-Cas engages in "collateral" cleavage of nearby non-targeted nucleic acids (i.e., RNA and/or ssDNA). This crRNA-programmed collateral cleavage activity allows CRISPR-Cas to detect the presence of a specific DNA in vivo by triggering programmed cell death or by nonspecific degradation of labelled RNA or ssDNA. Here is described an in vitro nucleic acid detection platform with high sensitivity based on nucleic acid amplification and CRISPR-Cas-mediated collateral cleavage of a commercial reporter RNA, allowing for real-time detection of the target.

Conservation of non-specific ss DNA and RNA directed proteins will inevitably lead to further and, potentially, improved CRISPR proteins that demonstrate collateral cleavage and may be used for detection and offer greater breadth for multiplexed detection of nucleic acid targets in amplified and highly sensitive, especially SHERLOCK, diagnostic systems.

RNA-Based Masking

In certain example embodiments, an RNA-based masking construct suppresses generation of a detectable positive signal, or the RNA-based masking construct suppresses generation of a detectable positive signal by masking the detectable positive signal, or generating a detectable negative signal instead, or the RNA-based masking construct comprises a silencing RNA that suppresses generation of a gene product encoded by a reporting construct, wherein the gene product generates the detectable positive signal when expressed.

In another example embodiment, the RNA-based masking construct is a ribozyme that generates a negative detectable signal, and wherein the positive detectable signal is generated when the ribozyme is deactivated. In one example embodiment, the ribozyme converts a substrate to a first color and wherein the substrate converts to a second color when the ribozyme is deactivated. In another example embodiment, the RNA-based masking agent is an aptamer that sequesters an enzyme, wherein the enzyme generates a detectable signal upon release from the aptamer by acting upon a substrate, or the aptamer sequesters a pair of agents that when released from the aptamers combine to generate a detectable signal.

In another example embodiment, the RNA-based masking construct comprises an RNA oligonucleotide to which are attached a detectable ligand oligonucleotide and a masking component. In certain example embodiments, the detectable ligand is a fluorophore and the masking component is a quencher molecule.

In another aspect, the invention provides a method for detecting target nucleic acid (e.g.,) RNAs in samples, comprising: distributing a sample or set of samples into one or more individual discrete volumes, the individual discrete volumes comprising a CRISPR system comprising an effector protein, one or more guide RNAs, an RNA-based masking construct; incubating the sample or set of samples under conditions sufficient to allow binding of the one or more guide RNAs to one or more target molecules; activating the CRISPR effector protein via binding of the one or more guide RNAs to the one or more target molecules, wherein activating the CRISPR effector protein results in modification of the RNA-based masking construct such that a detectable positive signal is produced; and detecting the detectable positive signal, wherein detection of the detectable positive signal indicates a presence of one or more target molecules in the sample.

In some embodiments, the method for detecting a target nucleic acid in a sample comprising: contacting a sample with: an engineered CRISPR-Cas protein; at least one guide polynucleotide comprising a guide sequence capable of binding to the target nucleic acid and designed to form a complex with the engineered CRISPR-Cas; and a RNA-based masking construct comprising a non-target sequence; wherein the engineered CRISPR-Cas protein exhibits collateral RNase activity and cleaves the non-target sequence of the detection construct; and detecting a signal from cleavage of the non-target sequence, thereby detecting the target nucleic acid in the sample. In some embodiments, the method further comprises contacting the sample with reagents for amplifying the target nucleic acid. In some embodiments, the reagents for amplifying comprises isothermal amplification reaction reagents. In some embodiments, the isothermal amplification reagents comprise nucleic-acid sequence-based amplification, recombinase polymerase amplification, loop-mediated isothermal amplification, strand displacement amplification, helicase-dependent amplification, or nicking enzyme amplification reagents.

In some embodiments, the target nucleic acid is DNA molecule and the method further comprises contacting the target DNA molecule with a primer comprising an RNA polymerase site and RNA polymerase.

In some embodiments, the masking construct: suppresses generation of a detectable positive signal until the masking construct cleaved or deactivated, or masks a detectable positive signal or generates a detectable negative signal until the masking construct cleaved or deactivated.

In some embodiments, the masking construct comprises: a. a silencing RNA that suppresses generation of a gene product encoded by a reporting construct, wherein the gene product generates the detectable positive signal when expressed; b. a ribozyme that generates the negative detectable signal, and wherein the positive detectable signal is generated when the ribozyme is deactivated; or c. a ribozyme that converts a substrate to a first color and wherein the substrate converts to a second color when the ribozyme is deactivated; d. an aptamer and/or comprises a polynucleotide-tethered inhibitor; e. a polynucleotide to which a detectable ligand and a masking component are attached; f. a nanoparticle held in aggregate by bridge molecules, wherein at least a portion of the bridge molecules comprises a polynucleotide, and wherein the solution undergoes a color shift when the nanoparticle is disbursed in solution; g. a quantum dot or fluorophore linked to one or more quencher molecules by a linking molecule, wherein at least a portion of the linking molecule comprises a polynucleotide; h. a polynucleotide in complex with an intercalating agent, wherein the intercalating agent changes absorbance upon cleavage of the polynucleotide; or 1. two fluorophores tethered by a polynucleotide that undergo a shift in fluorescence when released from the polynucleotide. In some embodiments, the aptamer a. comprises a polynucleotide-tethered inhibitor that sequesters an enzyme, wherein the enzyme generates a detectable signal upon release from the aptamer or polynucleotide-tethered inhibitor by acting upon a substrate; or b. is an inhibitory aptamer that inhibits an enzyme and prevents the enzyme from catalyzing generation of a detectable signal from a substrate or wherein the polynucleotide-tethered inhibitor inhibits an enzyme and prevents the enzyme from catalyzing generation of a detectable signal from a substrate; or c. sequesters a pair of agents that when released from the aptamers combine to generate a detectable signal. In some embodiments, the nanoparticle is a colloidal metal. In some embodiments, the at least one guide polynucleotide comprises a mismatch. In some embodiments, the mismatch is up- or downstream of a single nucleotide variation on the one or more guide sequences.

In another aspect, the invention provides a method for detecting peptides in samples, comprising: distributing a sample or set of samples into a set of individual discrete volumes, the individual discrete volumes comprising peptide detection aptamers, a CRISPR system comprising an effector protein, one or more guide RNAs, an RNA-based masking construct, wherein the peptide detection aptamers comprising a masked RNA polymerase site and configured to bind one or more target molecules; incubating the sample or set of samples under conditions sufficient to allow binding of the peptide detection aptamers to the one or more target molecules, wherein binding of the aptamer to a corresponding target molecule exposes the RNA polymerase binding site resulting in RNA synthesis of a trigger RNA; activating the CRISPR effector protein via binding of the one or more guide RNAs to the trigger RNA, wherein activating the CRISPR effector protein results in modification of the RNA-based masking construct such that a detectable positive signal is produced; and detecting the detectable positive signal, wherein detection of the detectable positive signal indicates a presence of one or more target molecules in a sample.

In certain example embodiments, the one or more guide RNAs are designed to bind to one or more target molecules that are diagnostic for a disease state. In certain other example embodiments, the disease state is an infection, an organ disease, a blood disease, an immune system disease, a cancer, a brain and nervous system disease, an endocrine disease, a pregnancy or childbirth-related disease, an inherited disease, or an environmentally-acquired disease, cancer, or a fungal infection, a bacterial infection, a parasite infection, or a viral infection.

In certain example embodiments, the RNA-based masking construct suppresses generation of a detectable positive signal, or the RNA-based masking construct suppresses generation of a detectable positive signal by masking the detectable positive signal, or generating a detectable negative signal instead, or the RNA-based masking construct comprises a silencing RNA that suppresses generation of a gene product encoded by a reporting construct, wherein the gene product generates the detectable positive signal when expressed, or the RNA-based masking construct is a ribozyme that generates the negative detectable signal, and wherein the positive detectable signal is generated when the ribozyme is inactivated. In other example embodiments, the ribozyme converts a substrate to a first state and wherein the substrate converts to a second state when the ribozyme is inactivated, or the RNA-based masking agent is an aptamer, or the aptamer sequesters an enzyme, wherein the enzyme generates a detectable signal upon release from the aptamer by acting upon a substrate, or the aptamer sequesters a pair of agents that when released from the aptamers combine to generate a detectable signal. In still further embodiments, the RNA-based masking construct comprises an RNA oligonucleotide with a detectable ligand on a first end of the RNA oligonucleotide and a masking component on a second end of the RNA oligonucleotide, or the detectable ligand is a fluorophore and the masking component is a quencher molecule.

Base Editing

The present disclosure also provides for a base editing system. In general, such a system may comprise a deaminase (e.g., an adenosine deaminase or cytidine deaminase) fused with a Cas protein. The Cas protein may be a dead Cas protein or a Cas nickase protein. In certain examples, the system comprises a mutated form of an adenosine deaminase fused with a dead CRISPR-Cas or CRISPR-Cas nickase. The mutated form of the adenosine deaminase may have both adenosine deaminase and cytidine deaminase activities.

In certain example embodiments, a dCas13b can be fused with an adenosine deaminase or cytidine deaminase for base editing purposes. In some cases, the dCas13b is dCas13b-t1, dCas13b-t2, or dCas13b-t3.

Figure 101:
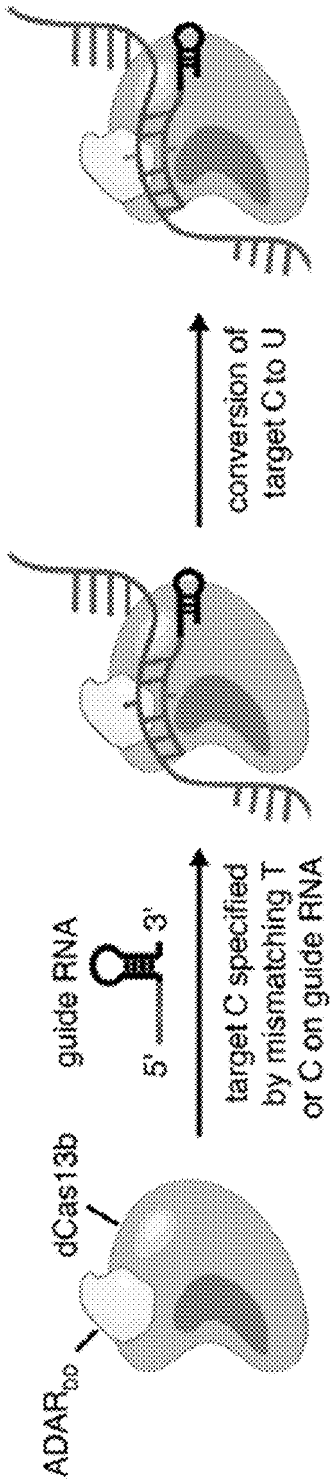
FIG. 101 shows an example system and method of programable cytidine to uridine conversion according to some embodiments herein.
Figure 102:
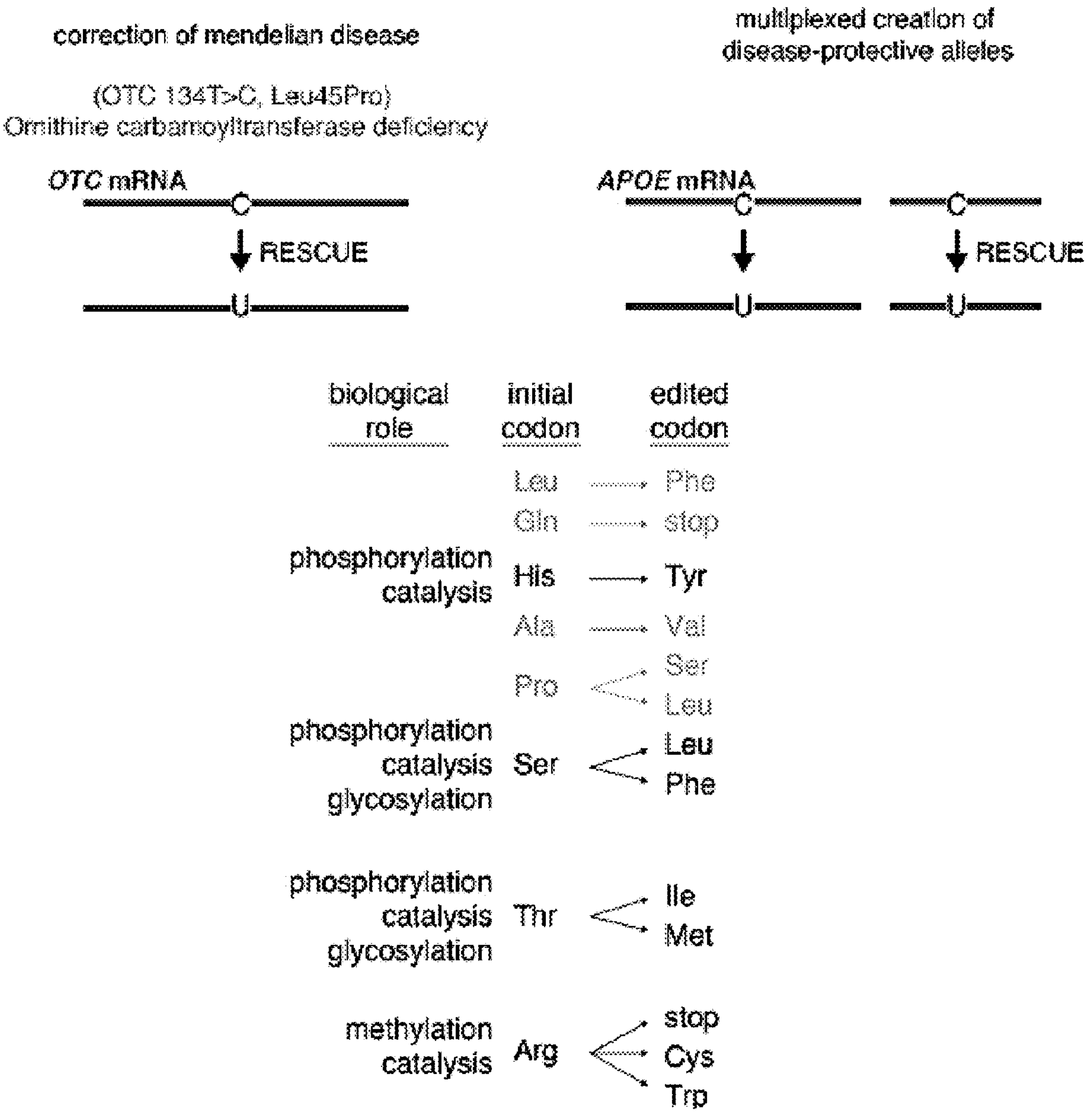
FIG. 102 shows example approaches of correcting mutations and/or targeting post-translational signaling or catalysis using base editors according to some embodiments herein.

In one aspect, the present disclosure provides an engineered adenosine deaminase. The engineered adenosine deaminase may comprise one or more mutations herein. In some embodiments, the engineered adenosine deaminase has cytidine deaminase activity. In certain examples, the engineered adenosine deaminase has both cytidine deaminase activity and adenosine deaminase. FIG. 101 shows an example system and method of programable cytidine to uridine conversion according to some embodiments herein. In some cases, the modifications by base editors herein may be used for targeting post-translational signaling or catalysis. FIG. 102 shows examples approaches.

Adenosine Deaminase

The term "adenosine deaminase" or "adenosine deaminase protein" as used herein refers to a protein, a polypeptide, or one or more functional domain(s) of a protein or a polypeptide that is capable of catalyzing a hydrolytic deamination reaction that converts an adenine (or an adenine moiety of a molecule) to a hypoxanthine (or a hypoxanthine moiety of a molecule), as shown below. In some embodiments, the adenine-containing molecule is an adenosine (A), and the hypoxanthine-containing molecule is an inosine (I). The adenine-containing molecule can be deoxyribonucleic acid (DNA) or ribonucleic acid (RNA).

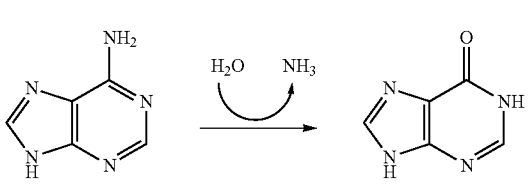

Adenine Hypoxanthine

According to the present disclosure, adenosine deaminases that can be used in connection with the present disclosure include, but are not limited to, members of the enzyme family known as adenosine deaminases that act on RNA (ADARs), members of the enzyme family known as adenosine deaminases that act on tRNA (ADATs), and other adenosine deaminase domain-containing (ADAD) family members. According to the present disclosure, the adenosine deaminase is capable of targeting adenine in a RNA/DNA and RNA duplexes. Indeed, Zheng et al. (Nucleic Acids Res. 2017, 45(6): 3369-3377) demonstrate that ADARs can carry out adenosine to inosine editing reactions on RNA/DNA and RNA/RNA duplexes. In particular embodiments, the adenosine deaminase has been modified to increase its ability to edit DNA in a RNA/DNA heteroduplex of in an RNA duplex as detailed herein below.

In some embodiments, the adenosine deaminase is derived from one or more metazoa species, including but not limited to, mammals, birds, frogs, squids, fish, flies and worms. In some embodiments, the adenosine deaminase is a human, squid or *Drosophila* adenosine deaminase.

In some embodiments, the adenosine deaminase is a human ADAR, including hADAR1, hADAR2, hADAR3. In some embodiments, the adenosine deaminase is a *Caenorhabditis elegans* ADAR protein, including ADR-1 and ADR-2. In some embodiments, the adenosine deaminase is a *Drosophila* ADAR protein, including dAdar. In some embodiments, the adenosine deaminase is a squid *Loligo pealeii* ADAR protein, including sqADAR2a and sqADAR2b. In some embodiments, the adenosine deaminase is a human ADAT protein. In some embodiments, the adenosine deaminase is a *Drosophila* ADAT protein. In some embodiments, the adenosine deaminase is a human ADAD protein, including TENR (hADAD1) and TENRL (hADAD2).

In some embodiments, the adenosine deaminase is a TadA protein such as *E. coli* TadA. See Kim et al., Biochemistry 45:6407-6416 (2006); Wolf et al., EMBO J. 21:3841-3851 (2002). In some embodiments, the adenosine deaminase is mouse ADA. See Grunebaum et al., Curr. Opin. Allergy Clin. Immunol. 13:630-638 (2013). In some embodiments, the adenosine deaminase is human ADAT2. See Fukui et al., J. Nucleic Acids 2010:260512 (2010). In some embodiments, the deaminase (e.g., adenosine or cytidine deaminase) is one or more of those described in Cox et al., Science. 2017, November 24; 358(6366): 1019-1027; Komore et al., Nature. 2016 May 19; 533(7603):420-4; and Gaudelli et al., Nature. 2017 Nov. 23; 551(7681):464-471.

In some embodiments, the adenosine deaminase protein recognizes and converts one or more target adenosine residue(s) in a double-stranded nucleic acid substrate into inosine residues(s). In some embodiments, the double-stranded nucleic acid substrate is a RNA-DNA hybrid duplex. In some embodiments, the adenosine deaminase protein recognizes a binding window on the double-stranded substrate. In some embodiments, the binding window contains at least one target adenosine residue(s). In some embodiments, the binding window is in the range of about 3 bp to about 100 bp. In some embodiments, the binding window is in the range of about 5 bp to about 50 bp. In some embodiments, the binding window is in the range of about 10 bp to about 30 bp. In some embodiments, the binding window is about 1 bp, 2 bp, 3 bp, 5 bp, 7 bp, 10 bp, 15 bp, 20 bp, 25 bp, 30 bp, 40 bp, 45 bp, 50 bp, 55 bp, 60 bp, 65 bp, 70 bp, 75 bp, 80 bp, 85 bp, 90 bp, 95 bp, or 100 bp.

In some embodiments, the adenosine deaminase protein comprises one or more deaminase domains. Not intended to be bound by a particular theory, it is contemplated that the deaminase domain functions to recognize and convert one or more target adenosine (A) residue(s) contained in a double-stranded nucleic acid substrate into inosine (I) residue(s). In some embodiments, the deaminase domain comprises an active center. In some embodiments, the active center comprises a zinc ion. In some embodiments, during the A-to-I editing process, base pairing at the target adenosine residue is disrupted, and the target adenosine residue is "flipped" out of the double helix to become accessible by the adenosine deaminase. In some embodiments, amino acid residues in or near the active center interact with one or more nucleotide(s) 5' to a target adenosine residue. In some embodiments, amino acid residues in or near the active center interact with one or more nucleotide(s) 3' to a target adenosine residue. In some embodiments, amino acid residues in or near the active center further interact with the nucleotide complementary to the target adenosine residue on the opposite strand. In some embodiments, the amino acid residues form hydrogen bonds with the 2' hydroxyl group of the nucleotides.

In some embodiments, the adenosine deaminase comprises human ADAR2 full protein (hADAR2) or the deaminase domain thereof (hADAR2-D). In some embodiments, the adenosine deaminase is an ADAR family member that is homologous to hADAR2 or hADAR2-D.

Particularly, in some embodiments, the homologous ADAR protein is human ADAR1 (hADAR1) or the deaminase domain thereof (hADAR1-D). In some embodiments, glycine 1007 of hADAR1-D corresponds to glycine 487 hADAR2-D, and glutamic Acid 1008 of hADAR1-D corresponds to glutamic acid 488 of hADAR2-D.

In some embodiments, the adenosine deaminase comprises the wild-type amino acid sequence of hADAR2-D. In some embodiments, the adenosine deaminase comprises one or more mutations in the hADAR2-D sequence, such that the editing efficiency, and/or substrate editing preference of hADAR2-D is changed according to specific needs. The engineered adenosine deaminase may be fused with a Cas protein, e.g., Cas9, Cas 12 (e.g., Cas12a, Cas12b, Cas12c, Cas12d, etc.), Cas13 (e.g., Cas13a, Cas13b (such as Cas13b-t1, Cas13b-t2, Cas13b-t3), Cas13c, Cas13d, etc.), Cas14, CasX, CasY, or an engineered form of the Cas protein (e.g., an invective, dead form, a nickase form). In some examples, provided herein include an engineered adenosine deaminase fused with a dead Cas13b protein or Cas13 nickase.

Certain mutations of hADAR1 and hADAR2 proteins have been described in Kuttan et al., Proc Natl Acad Sci USA. (2012) 109(48):E3295-304; Want et al. ACS Chem Biol. (2015) 10(11):2512-9; and Zheng et al. Nucleic Acids Res. (2017) 45(6):3369-337, each of which is incorporated herein by reference in its entirety.

In some embodiments, the adenosine deaminase comprises a mutation at glycine336 of the hADAR2-D amino acid sequence, or a corresponding position in a homologous ADAR protein. In some embodiments, the glycine residue at position 336 is replaced by an aspartic acid residue (G336D).

In some embodiments, the adenosine deaminase comprises a mutation at Glycine487 of the hADAR2-D amino acid sequence, or a corresponding position in a homologous ADAR protein. In some embodiments, the glycine residue at position 487 is replaced by a non-polar amino acid residue with relatively small side chains. For example, in some embodiments, the glycine residue at position 487 is replaced by an alanine residue (G487A). In some embodiments, the glycine residue at position 487 is replaced by a valine residue (G487V). In some embodiments, the glycine residue at position 487 is replaced by an amino acid residue with relatively large side chains. In some embodiments, the glycine residue at position 487 is replaced by a arginine residue (G487R). In some embodiments, the glycine residue at position 487 is replaced by a lysine residue (G487K). In some embodiments, the glycine residue at position 487 is replaced by a tryptophan residue (G487W). In some embodiments, the glycine residue at position 487 is replaced by a tyrosine residue (G487Y).

In some embodiments, the adenosine deaminase comprises a mutation at glutamic acid488 of the hADAR2-D amino acid sequence, or a corresponding position in a homologous ADAR protein. In some embodiments, the glutamic acid residue at position 488 is replaced by a glutamine residue (E488Q). In some embodiments, the glutamic acid residue at position 488 is replaced by a histidine residue (E488H). In some embodiments, the glutamic acid residue at position 488 is replace by an arginine residue (E488R). In some embodiments, the glutamic acid residue at position 488 is replace by a lysine residue (E488K). In some embodiments, the glutamic acid residue at position 488 is replace by an asparagine residue (E488N). In some embodiments, the glutamic acid residue at position 488 is replace by an alanine residue (E488A). In some embodiments, the glutamic acid residue at position 488 is replace by a Methionine residue (E488M). In some embodiments, the glutamic acid residue at position 488 is replace by a serine residue (E488S). In some embodiments, the glutamic acid residue at position 488 is replace by a phenylalanine residue (E488F). In some embodiments, the glutamic acid residue at position 488 is replace by a lysine residue (E488L). In some embodiments, the glutamic acid residue at position 488 is replace by a tryptophan residue (E488W).

In some embodiments, the adenosine deaminase comprises a mutation at threonine490 of the hADAR2-D amino acid sequence, or a corresponding position in a homologous ADAR protein. In some embodiments, the threonine residue at position 490 is replaced by a cysteine residue (T490C). In some embodiments, the threonine residue at position 490 is replaced by a serine residue (T490S). In some embodiments, the threonine residue at position 490 is replaced by an alanine residue (T490A). In some embodiments, the threonine residue at position 490 is replaced by a phenylalanine residue (T490F). In some embodiments, the threonine residue at position 490 is replaced by a tyrosine residue (T490Y). In some embodiments, the threonine residue at position 490 is replaced by a serine residue (T490R). In some embodiments, the threonine residue at position 490 is replaced by an alanine residue (T490K). In some embodiments, the threonine residue at position 490 is replaced by a phenylalanine residue (T490P). In some embodiments, the threonine residue at position 490 is replaced by a tyrosine residue (T490E).

In some embodiments, the adenosine deaminase comprises a mutation at valine493 of the hADAR2-D amino acid sequence, or a corresponding position in a homologous ADAR protein. In some embodiments, the valine residue at position 493 is replaced by an alanine residue (V493A). In some embodiments, the valine residue at position 493 is replaced by a serine residue (V493S). In some embodiments, the valine residue at position 493 is replaced by a threonine residue (V493T). In some embodiments, the valine residue at position 493 is replaced by an arginine residue (V493R). In some embodiments, the valine residue at position 493 is replaced by an aspartic acid residue (V493D). In some embodiments, the valine residue at position 493 is replaced by a proline residue (V493P). In some embodiments, the valine residue at position 493 is replaced by a glycine residue (V493G).

In some embodiments, the adenosine deaminase comprises a mutation at alanine589 of the hADAR2-D amino acid sequence, or a corresponding position in a homologous ADAR protein. In some embodiments, the alanine residue at position 589 is replaced by a valine residue (A589V).

In some embodiments, the adenosine deaminase comprises a mutation at asparagine597 of the hADAR2-D amino acid sequence, or a corresponding position in a homologous ADAR protein. In some embodiments, the asparagine residue at position 597 is replaced by a lysine residue (N597K). In some embodiments, the adenosine deaminase comprises a mutation at position 597 of the amino acid sequence, which has an asparagine residue in the wild type sequence. In some embodiments, the asparagine residue at position 597 is replaced by an arginine residue (N597R). In some embodiments, the adenosine deaminase comprises a mutation at position 597 of the amino acid sequence, which has an asparagine residue in the wild type sequence. In some embodiments, the asparagine residue at position 597 is replaced by an alanine residue (N597A). In some embodiments, the adenosine deaminase comprises a mutation at position 597 of the amino acid sequence, which has an asparagine residue in the wild type sequence. In some embodiments, the asparagine residue at position 597 is replaced by a glutamic acid residue (N597E). In some embodiments, the adenosine deaminase comprises a mutation at position 597 of the amino acid sequence, which has an asparagine residue in the wild type sequence. In some embodiments, the asparagine residue at position 597 is replaced by a histidine residue (N597H). In some embodiments, the adenosine deaminase comprises a mutation at position 597 of the amino acid sequence, which has an asparagine residue in the wild type sequence. In some embodiments, the asparagine residue at position 597 is replaced by a glycine residue (N597G). In some embodiments, the adenosine deaminase comprises a mutation at position 597 of the amino acid sequence, which has an asparagine residue in the wild type sequence. In some embodiments, the asparagine residue at position 597 is replaced by a tyrosine residue (N597Y). In some embodiments, the asparagine residue at position 597 is replaced by a phenylalanine residue (N597F). In some embodiments, the adenosine deaminase comprises mutation N597I. In some embodiments, the adenosine deaminase comprises mutation N597L. In some embodiments, the adenosine deaminase comprises mutation N597V. In some embodiments, the adenosine deaminase comprises mutation N597M. In some embodiments, the adenosine deaminase comprises mutation N597C. In some embodiments, the adenosine deaminase comprises mutation N597P. In some embodiments, the adenosine deaminase comprises mutation N597T. In some embodiments, the adenosine deaminase comprises mutation N597S. In some embodiments, the adenosine deaminase comprises mutation N597W. In some embodiments, the adenosine deaminase comprises mutation N597Q. In some embodiments, the adenosine deaminase comprises mutation N597D. In certain example embodiments, the mutations at N597 described above are further made in the context of an E488Q background In some embodiments, the adenosine deaminase comprises a mutation at serine599 of the hADAR2-D amino acid sequence, or a corresponding position in a homologous ADAR protein. In some embodiments, the serine residue at position 599 is replaced by a threonine residue (S599T).

In some embodiments, the adenosine deaminase comprises a mutation at asparagine613 of the hADAR2-D amino acid sequence, or a corresponding position in a homologous ADAR protein. In some embodiments, the asparagine residue at position 613 is replaced by a lysine residue (N613K). In some embodiments, the adenosine deaminase comprises a mutation at position 613 of the amino acid sequence, which has an asparagine residue in the wild type sequence.

In some embodiments, the asparagine residue at position 613 is replaced by an arginine residue (N613R). In some embodiments, the adenosine deaminase comprises a mutation at position 613 of the amino acid sequence, which has an asparagine residue in the wild type sequence. In some embodiments, the asparagine residue at position 613 is replaced by an alanine residue (N613A) In some embodiments, the adenosine deaminase comprises a mutation at position 613 of the amino acid sequence, which has an asparagine residue in the wild type sequence. In some embodiments, the asparagine residue at position 613 is replaced by a glutamic acid residue (N613E). In some embodiments, the adenosine deaminase comprises mutation N613I. In some embodiments, the adenosine deaminase comprises mutation N613L. In some embodiments, the adenosine deaminase comprises mutation N613V. In some embodiments, the adenosine deaminase comprises mutation N613F. In some embodiments, the adenosine deaminase comprises mutation N613M. In some embodiments, the adenosine deaminase comprises mutation N613C. In some embodiments, the adenosine deaminase comprises mutation N613G. In some embodiments, the adenosine deaminase comprises mutation N613P. In some embodiments, the adenosine deaminase comprises mutation N613T. In some embodiments, the adenosine deaminase comprises mutation N613S. In some embodiments, the adenosine deaminase comprises mutation N613Y. In some embodiments, the adenosine deaminase comprises mutation N613W. In some embodiments, the adenosine deaminase comprises mutation N613Q. In some embodiments, the adenosine deaminase comprises mutation N613H. In some embodiments, the adenosine deaminase comprises mutation N613D. In some embodiments, the mutations at N613 described above are further made in combination with a E488Q mutation.

In some embodiments, to improve editing efficiency, the adenosine deaminase may comprise one or more of the mutations: G336D, G487A, G487V, E488Q, E488H, E488R, E488N, E488A, E488S, E488M, T490C, T490S, V493T, V493S, V493A, V493R, V493D, V493P, V493G, N597K, N597R, N597A, N597E, N597H, N597G, N597Y, A589V, S599T, N613K, N613R, N613A, N613E, based on amino acid sequence positions of hADAR2-D, and mutations in a homologous ADAR protein corresponding to the above.

In some embodiments, to reduce editing efficiency, the adenosine deaminase may comprise one or more of the mutations: E488F, E488L, E488W, T490A, T490F, T490Y, T490R, T490K, T490P, T490E, N597F, based on amino acid sequence positions of hADAR2-D, and mutations in a homologous ADAR protein corresponding to the above. In particular embodiments, it can be of interest to use an adenosine deaminase enzyme with reduced efficacy to reduce off-target effects.

In some embodiments, to reduce off-target effects, the adenosine deaminase comprises one or more of mutations at R348, V351, T375, K376, E396, C451, R455, N473, R474, K475, R477, R481, S486, E488, T490, S495, R510, based on amino acid sequence positions of hADAR2-D, and mutations in a homologous ADAR protein corresponding to the above. In some embodiments, the adenosine deaminase comprises mutation at E488 and one or more additional positions selected from R348, V351, T375, K376, E396, C451, R455, N473, R474, K475, R477, R481, S486, T490, S495, R510. In some embodiments, the adenosine deaminase comprises mutation at T375, and optionally at one or more additional positions. In some embodiments, the adenosine deaminase comprises mutation at N473, and optionally at one or more additional positions. In some embodiments, the adenosine deaminase comprises mutation at V351, and optionally at one or more additional positions. In some embodiments, the adenosine deaminase comprises mutation at E488 and T375, and optionally at one or more additional positions. In some embodiments, the adenosine deaminase comprises mutation at E488 and N473, and optionally at one or more additional positions. In some embodiments, the adenosine deaminase comprises mutation E488 and V351, and optionally at one or more additional positions. In some embodiments, the adenosine deaminase comprises mutation at E488 and one or more of T375, N473, and V351.

In some embodiments, to reduce off-target effects, the adenosine deaminase comprises one or more of mutations selected from R348E, V351L, T375G, T375S, R455G, R455S, R455E, N473D, R474E, K475Q, R477E, R481E, S486T, E488Q, T490A, T490S, S495T, and R510E, based on amino acid sequence positions of hADAR2-D, and mutations in a homologous ADAR protein corresponding to the above. In some embodiments, the adenosine deaminase comprises mutation E488Q and one or more additional mutations selected from R348E, V351L, T375G, T375S, R455G, R455S, R455E, N473D, R474E, K475Q, R477E, R481E, S486T, T490A, T490S, S495T, and R510E. In some embodiments, the adenosine deaminase comprises mutation T375G or T375S, and optionally one or more additional mutations. In some embodiments, the adenosine deaminase comprises mutation N473D, and optionally one or more additional mutations. In some embodiments, the adenosine deaminase comprises mutation V351L, and optionally one or more additional mutations. In some embodiments, the adenosine deaminase comprises mutation E488Q, and T375G or T375G, and optionally one or more additional mutations. In some embodiments, the adenosine deaminase comprises mutation E488Q and N473D, and optionally one or more additional mutations. In some embodiments, the adenosine deaminase comprises mutation E488Q and V351L, and optionally one or more additional mutations. In some embodiments, the adenosine deaminase comprises mutation E488Q and one or more of T375G/S, N473D and V351L.

In certain examples, the adenosine deaminase protein or catalytic domain thereof has been modified to comprise a mutation at E488, preferably E488Q, of the hADAR2-D amino acid sequence, or a corresponding position in a homologous ADAR protein and/or wherein the adenosine deaminase protein or catalytic domain thereof has been modified to comprise a mutation at T375, preferably T375G of the hADAR2-D amino acid sequence, or a corresponding position in a homologous ADAR protein. In certain examples, the adenosine deaminase protein or catalytic domain thereof has been modified to comprise a mutation at E1008, preferably E1008Q, of the hADAR1d amino acid sequence, or a corresponding position in a homologous ADAR protein.

Crystal structures of the human ADAR2 deaminase domain bound to duplex RNA reveal a protein loop that binds the RNA on the 5' side of the modification site. This 5' binding loop is one contributor to substrate specificity differences between ADAR family members. See Wang et al., Nucleic Acids Res., 44(20):9872-9880 (2016), the content of which is incorporated herein by reference in its entirety. In addition, an ADAR2-specific RNA-binding loop was identified near the enzyme active site. See Mathews et al., Nat. Struct. Mol. Biol., 23(5):426-33 (2016), the content of which is incorporated herein by reference in its entirety.

In some embodiments, the adenosine deaminase comprises one or more mutations in the RNA binding loop to improve editing specificity and/or efficiency.

In some embodiments, the adenosine deaminase comprises a mutation at alanine454 of the hADAR2-D amino acid sequence, or a corresponding position in a homologous ADAR protein. In some embodiments, the alanine residue at position 454 is replaced by a serine residue (A454S). In some embodiments, the alanine residue at position 454 is replaced by a cysteine residue (A454C). In some embodiments, the alanine residue at position 454 is replaced by an aspartic acid residue (A454D).

In some embodiments, the adenosine deaminase comprises a mutation at arginine455 of the hADAR2-D amino acid sequence, or a corresponding position in a homologous ADAR protein. In some embodiments, the arginine residue at position 455 is replaced by an alanine residue (R455A). In some embodiments, the arginine residue at position 455 is replaced by a valine residue (R455V). In some embodiments, the arginine residue at position 455 is replaced by a histidine residue (R455H). In some embodiments, the arginine residue at position 455 is replaced by a glycine residue (R455G). In some embodiments, the arginine residue at position 455 is replaced by a serine residue (R455S). In some embodiments, the arginine residue at position 455 is replaced by a glutamic acid residue (R455E). In some embodiments, the adenosine deaminase comprises mutation R455C. In some embodiments, the adenosine deaminase comprises mutation R455I. In some embodiments, the adenosine deaminase comprises mutation R455K. In some embodiments, the adenosine deaminase comprises mutation R455L. In some embodiments, the adenosine deaminase comprises mutation R455M. In some embodiments, the adenosine deaminase comprises mutation R455N. In some embodiments, the adenosine deaminase comprises mutation R455Q. In some embodiments, the adenosine deaminase comprises mutation R455F. In some embodiments, the adenosine deaminase comprises mutation R455W. In some embodiments, the adenosine deaminase comprises mutation R455P. In some embodiments, the adenosine deaminase comprises mutation R455Y. In some embodiments, the adenosine deaminase comprises mutation R455E. In some embodiments, the adenosine deaminase comprises mutation R455D. In some embodiments, the mutations at R455 described above are further made in combination with a E488Q mutation.

In some embodiments, the adenosine deaminase comprises a mutation at isoleucine456 of the hADAR2-D amino acid sequence, or a corresponding position in a homologous ADAR protein. In some embodiments, the isoleucine residue at position 456 is replaced by a valine residue (I456V). In some embodiments, the isoleucine residue at position 456 is replaced by a leucine residue (I456L). In some embodiments, the isoleucine residue at position 456 is replaced by an aspartic acid residue (I456D).

In some embodiments, the adenosine deaminase comprises a mutation at phenylalanine457 of the hADAR2-D amino acid sequence, or a corresponding position in a homologous ADAR protein. In some embodiments, the phenylalanine residue at position 457 is replaced by a tyrosine residue (F457Y). In some embodiments, the phenylalanine residue at position 457 is replaced by an arginine residue (F457R). In some embodiments, the phenylalanine residue at position 457 is replaced by a glutamic acid residue (F457E).

In some embodiments, the adenosine deaminase comprises a mutation at serine458 of the hADAR2-D amino acid sequence, or a corresponding position in a homologous ADAR protein. In some embodiments, the serine residue at position 458 is replaced by a valine residue (S458V). In some embodiments, the serine residue at position 458 is replaced by a phenylalanine residue (S458F). In some embodiments, the serine residue at position 458 is replaced by a proline residue (S458P). In some embodiments, the adenosine deaminase comprises mutation S458I. In some embodiments, the adenosine deaminase comprises mutation S458L. In some embodiments, the adenosine deaminase comprises mutation S458M. In some embodiments, the adenosine deaminase comprises mutation S458C. In some embodiments, the adenosine deaminase comprises mutation S458A. In some embodiments, the adenosine deaminase comprises mutation S458G. In some embodiments, the adenosine deaminase comprises mutation S458T. In some embodiments, the adenosine deaminase comprises mutation S458Y. In some embodiments, the adenosine deaminase comprises mutation S458W. In some embodiments, the adenosine deaminase comprises mutation S458Q. In some embodiments, the adenosine deaminase comprises mutation S458N. In some embodiments, the adenosine deaminase comprises mutation S458H. In some embodiments, the adenosine deaminase comprises mutation S458E. In some embodiments, the adenosine deaminase comprises mutation S458D. In some embodiments, the adenosine deaminase comprises mutation S458K. In some embodiments, the adenosine deaminase comprises mutation S458R. In some embodiments, the mutations at S458 described above are further made in combination with a E488Q mutation.

In some embodiments, the adenosine deaminase comprises a mutation at proline459 of the hADAR2-D amino acid sequence, or a corresponding position in a homologous ADAR protein. In some embodiments, the proline residue at position 459 is replaced by a cysteine residue (P459C). In some embodiments, the proline residue at position 459 is replaced by a histidine residue (P459H). In some embodiments, the proline residue at position 459 is replaced by a tryptophan residue (P459W).

In some embodiments, the adenosine deaminase comprises a mutation at histidine460 of the hADAR2-D amino acid sequence, or a corresponding position in a homologous ADAR protein. In some embodiments, the histidine residue at position 460 is replaced by an arginine residue (H460R). In some embodiments, the histidine residue at position 460 is replaced by an isoleucine residue (H460I). In some embodiments, the histidine residue at position 460 is replaced by a proline residue (H460P). In some embodiments, the adenosine deaminase comprises mutation H460L. In some embodiments, the adenosine deaminase comprises mutation H460V. In some embodiments, the adenosine deaminase comprises mutation H460F. In some embodiments, the adenosine deaminase comprises mutation H460M. In some embodiments, the adenosine deaminase comprises mutation H460C. In some embodiments, the adenosine deaminase comprises mutation H460A. In some embodiments, the adenosine deaminase comprises mutation H460G. In some embodiments, the adenosine deaminase comprises mutation H460T. In some embodiments, the adenosine deaminase comprises mutation H460S. In some embodiments, the adenosine deaminase comprises mutation H460Y. In some embodiments, the adenosine deaminase comprises mutation H460W. In some embodiments, the adenosine deaminase comprises mutation H460Q. In some embodiments, the adenosine deaminase comprises mutation H460N. In some embodiments, the adenosine deaminase comprises mutation H460E. In some embodiments, the adenosine deaminase comprises mutation H460D. In some embodiments, the adenosine deaminase comprises mutation H460K. In some embodiments, the mutations at H460 described above are further made in combination with a E488Q mutation.

In some embodiments, the adenosine deaminase comprises a mutation at proline462 of the hADAR2-D amino acid sequence, or a corresponding position in a homologous ADAR protein. In some embodiments, the proline residue at position 462 is replaced by a serine residue (P462S). In some embodiments, the proline residue at position 462 is replaced by a tryptophan residue (P462W). In some embodiments, the proline residue at position 462 is replaced by a glutamic acid residue (P462E).

In some embodiments, the adenosine deaminase comprises a mutation at aspartic acid469 of the hADAR2-D amino acid sequence, or a corresponding position in a homologous ADAR protein. In some embodiments, the aspartic acid residue at position 469 is replaced by a glutamine residue (D469Q). In some embodiments, the aspartic acid residue at position 469 is replaced by a serine residue (D469S). In some embodiments, the aspartic acid residue at position 469 is replaced by a tyrosine residue (D469Y).

In some embodiments, the adenosine deaminase comprises a mutation at arginine470 of the hADAR2-D amino acid sequence, or a corresponding position in a homologous ADAR protein. In some embodiments, the arginine residue at position 470 is replaced by an alanine residue (R470A). In some embodiments, the arginine residue at position 470 is replaced by an isoleucine residue (R470I). In some embodiments, the arginine residue at position 470 is replaced by an aspartic acid residue (R470D).

In some embodiments, the adenosine deaminase comprises a mutation at histidine471 of the hADAR2-D amino acid sequence, or a corresponding position in a homologous ADAR protein. In some embodiments, the histidine residue at position 471 is replaced by a lysine residue (H471K). In some embodiments, the histidine residue at position 471 is replaced by a threonine residue (H471T). In some embodiments, the histidine residue at position 471 is replaced by a valine residue (H471V).

In some embodiments, the adenosine deaminase comprises a mutation at proline472 of the hADAR2-D amino acid sequence, or a corresponding position in a homologous ADAR protein. In some embodiments, the proline residue at position 472 is replaced by a lysine residue (P472K). In some embodiments, the proline residue at position 472 is replaced by a threonine residue (P472T). In some embodiments, the proline residue at position 472 is replaced by an aspartic acid residue (P472D).

In some embodiments, the adenosine deaminase comprises a mutation at asparagine473 of the hADAR2-D amino acid sequence, or a corresponding position in a homologous ADAR protein. In some embodiments, the asparagine residue at position 473 is replaced by an arginine residue (N473R). In some embodiments, the asparagine residue at position 473 is replaced by a tryptophan residue (N473W). In some embodiments, the asparagine residue at position 473 is replaced by a proline residue (N473P). In some embodiments, the asparagine residue at position 473 is replaced by an aspartic acid residue (N473D).

In some embodiments, the adenosine deaminase comprises a mutation at arginine 474 of the hADAR2-D amino acid sequence, or a corresponding position in a homologous ADAR protein. In some embodiments, the arginine residue at position 474 is replaced by a lysine residue (R474K). In some embodiments, the arginine residue at position 474 is replaced by a glycine residue (R474G). In some embodiments, the arginine residue at position 474 is replaced by an aspartic acid residue (R474D). In some embodiments, the arginine residue at position 474 is replaced by a glutamic acid residue (R474E).

In some embodiments, the adenosine deaminase comprises a mutation at lysine475 of the hADAR2-D amino acid sequence, or a corresponding position in a homologous ADAR protein. In some embodiments, the lysine residue at position 475 is replaced by a glutamine residue (K475Q). In some embodiments, the lysine residue at position 475 is replaced by an asparagine residue (K475N). In some embodiments, the lysine residue at position 475 is replaced by an aspartic acid residue (K475D).

In some embodiments, the adenosine deaminase comprises a mutation at alanine476 of the hADAR2-D amino acid sequence, or a corresponding position in a homologous ADAR protein. In some embodiments, the alanine residue at position 476 is replaced by a serine residue (A476S). In some embodiments, the alanine residue at position 476 is replaced by an arginine residue (A476R). In some embodiments, the alanine residue at position 476 is replaced by a glutamic acid residue (A476E).

In some embodiments, the adenosine deaminase comprises a mutation at arginine477 of the hADAR2-D amino acid sequence, or a corresponding position in a homologous ADAR protein. In some embodiments, the arginine residue at position 477 is replaced by a lysine residue (R477K). In some embodiments, the arginine residue at position 477 is replaced by a threonine residue (R477T). In some embodiments, the arginine residue at position 477 is replaced by a phenylalanine residue (R477F). In some embodiments, the arginine residue at position 474 is replaced by a glutamic acid residue (R477E).

In some embodiments, the adenosine deaminase comprises a mutation at glycine478 of the hADAR2-D amino acid sequence, or a corresponding position in a homologous ADAR protein. In some embodiments, the glycine residue at position 478 is replaced by an alanine residue (G478A). In some embodiments, the glycine residue at position 478 is replaced by an arginine residue (G478R). In some embodiments, the glycine residue at position 478 is replaced by a tyrosine residue (G478Y). In some embodiments, the adenosine deaminase comprises mutation G478I. In some embodiments, the adenosine deaminase comprises mutation G478L. In some embodiments, the adenosine deaminase comprises mutation G478V. In some embodiments, the adenosine deaminase comprises mutation G478F. In some embodiments, the adenosine deaminase comprises mutation G478M. In some embodiments, the adenosine deaminase comprises mutation G478C. In some embodiments, the adenosine deaminase comprises mutation G478P. In some embodiments, the adenosine deaminase comprises mutation G478T. In some embodiments, the adenosine deaminase comprises mutation G478S. In some embodiments, the adenosine deaminase comprises mutation G478W. In some embodiments, the adenosine deaminase comprises mutation G478Q. In some embodiments, the adenosine deaminase comprises mutation G478N. In some embodiments, the adenosine deaminase comprises mutation G478H. In some embodiments, the adenosine deaminase comprises mutation G478E. In some embodiments, the adenosine deaminase comprises mutation G478D. In some embodiments, the adenosine deaminase comprises mutation G478K. In some embodiments, the mutations at G478 described above are further made in combination with a E488Q mutation.

In some embodiments, the adenosine deaminase comprises a mutation at glutamine479 of the hADAR2-D amino acid sequence, or a corresponding position in a homologous ADAR protein. In some embodiments, the glutamine residue at position 479 is replaced by an asparagine residue (Q479N). In some embodiments, the glutamine residue at position 479 is replaced by a serine residue (Q479S). In some embodiments, the glutamine residue at position 479 is replaced by a proline residue (Q479P).

In some embodiments, the adenosine deaminase comprises a mutation at arginine348 of the hADAR2-D amino acid sequence, or a corresponding position in a homologous ADAR protein. In some embodiments, the arginine residue at position 348 is replaced by an alanine residue (R348A). In some embodiments, the arginine residue at position 348 is replaced by a glutamic acid residue (R348E).

In some embodiments, the adenosine deaminase comprises a mutation at valine351 of the hADAR2-D amino acid sequence, or a corresponding position in a homologous ADAR protein. In some embodiments, the valine residue at position 351 is replaced by a leucine residue (V351L). In some embodiments, the adenosine deaminase comprises mutation V351Y. In some embodiments, the adenosine deaminase comprises mutation V351M. In some embodiments, the adenosine deaminase comprises mutation V351T. In some embodiments, the adenosine deaminase comprises mutation V351G. In some embodiments, the adenosine deaminase comprises mutation V351A. In some embodiments, the adenosine deaminase comprises mutation V351F. In some embodiments, the adenosine deaminase comprises mutation V351E. In some embodiments, the adenosine deaminase comprises mutation V351I. In some embodiments, the adenosine deaminase comprises mutation V351C. In some embodiments, the adenosine deaminase comprises mutation V351H. In some embodiments, the adenosine deaminase comprises mutation V351P. In some embodiments, the adenosine deaminase comprises mutation V351S. In some embodiments, the adenosine deaminase comprises mutation V351K. In some embodiments, the adenosine deaminase comprises mutation V351N. In some embodiments, the adenosine deaminase comprises mutation V351W. In some embodiments, the adenosine deaminase comprises mutation V351Q. In some embodiments, the adenosine deaminase comprises mutation V351D. In some embodiments, the adenosine deaminase comprises mutation V351R. In some embodiments, the mutations at V351 described above are further made in combination with a E488Q mutation.

In some embodiments, the adenosine deaminase comprises a mutation at threonine375 of the hADAR2-D amino acid sequence, or a corresponding position in a homologous ADAR protein. In some embodiments, the threonine residue at position 375 is replaced by a glycine residue (T375G). In some embodiments, the threonine residue at position 375 is replaced by a serine residue (T375S). In some embodiments, the adenosine deaminase comprises mutation T375H. In some embodiments, the adenosine deaminase comprises mutation T375Q. In some embodiments, the adenosine deaminase comprises mutation T375C. In some embodiments, the adenosine deaminase comprises mutation T375N. In some embodiments, the adenosine deaminase comprises mutation T375M. In some embodiments, the adenosine deaminase comprises mutation T375A. In some embodiments, the adenosine deaminase comprises mutation T375W. In some embodiments, the adenosine deaminase comprises mutation T375V. In some embodiments, the adenosine deaminase comprises mutation T375R. In some embodiments, the adenosine deaminase comprises mutation T375E. In some embodiments, the adenosine deaminase comprises mutation T375K. In some embodiments, the adenosine deaminase comprises mutation T375F. In some embodiments, the adenosine deaminase comprises mutation T375I. In some embodiments, the adenosine deaminase comprises mutation T375D. In some embodiments, the adenosine deaminase comprises mutation T375P. In some embodiments, the adenosine deaminase comprises mutation T375L. In some embodiments, the adenosine deaminase comprises mutation T375Y. In some embodiments, the mutations at T375Y described above are further made in combination with an E488Q mutation.

In some embodiments, the adenosine deaminase comprises a mutation at Arg481 of the hADAR2-D amino acid sequence, or a corresponding position in a homologous ADAR protein. In some embodiments, the arginine residue at position 481 is replaced by a glutamic acid residue (R481E).

In some embodiments, the adenosine deaminase comprises a mutation at Ser486 of the hADAR2-D amino acid sequence, or a corresponding position in a homologous ADAR protein. In some embodiments, the serine residue at position 486 is replaced by a threonine residue (S486T).

In some embodiments, the adenosine deaminase comprises a mutation at Thr490 of the hADAR2-D amino acid sequence, or a corresponding position in a homologous ADAR protein. In some embodiments, the threonine residue at position 490 is replaced by an alanine residue (T490A). In some embodiments, the threonine residue at position 490 is replaced by a serine residue (T490S).

In some embodiments, the adenosine deaminase comprises a mutation at Ser495 of the hADAR2-D amino acid sequence, or a corresponding position in a homologous ADAR protein. In some embodiments, the serine residue at position 495 is replaced by a threonine residue (S495T).

In some embodiments, the adenosine deaminase comprises a mutation at Arg510 of the hADAR2-D amino acid sequence, or a corresponding position in a homologous ADAR protein. In some embodiments, the arginine residue at position 510 is replaced by a glutamine residue (R510Q). In some embodiments, the arginine residue at position 510 is replaced by an alanine residue (R510A). In some embodiments, the arginine residue at position 510 is replaced by a glutamic acid residue (R510E).

In some embodiments, the adenosine deaminase comprises a mutation at Gly593 of the hADAR2-D amino acid sequence, or a corresponding position in a homologous ADAR protein. In some embodiments, the glycine residue at position 593 is replaced by an alanine residue (G593A). In some embodiments, the glycine residue at position 593 is replaced by a glutamic acid residue (G593E).

In some embodiments, the adenosine deaminase comprises a mutation at Lys594 of the hADAR2-D amino acid sequence, or a corresponding position in a homologous ADAR protein. In some embodiments, the lysine residue at position 594 is replaced by an alanine residue (K594A).

In some embodiments, the adenosine deaminase comprises a mutation at any one or more of positions A454, R455, 1456, F457, S458, P459, H460, P462, D469, R470, H471, P472, N473, R474, K475, A476, R477, G478, Q479, R348, R510, G593, K594 of the hADAR2-D amino acid sequence, or a corresponding position in a homologous ADAR protein.

In some embodiments, the adenosine deaminase comprises any one or more of mutations A454S, A454C, A454D, R455A, R455V, R455H, I456V, I456L, I456D, F457Y, F457R, F457E, S458V, S458F, S458P, P459C, P459H, P459W, H460R, H460I, H460P, P462S, P462W, P462E, D469Q, D469S, D469Y, R470A, R470I, R470D, H471K, H471T, H471V, P472K, P472T, P472D, N473R, N473W, N473P, R474K, R474G, R474D, K475Q, K475N, K475D, A476S, A476R, A476E, R477K, R477T, R477F, G478A, G478R, G478Y, Q479N, Q479S, Q479P, R348A, R510Q, R510A, G593A, G593E, K594A of the hADAR2-D amino acid sequence, or a corresponding position in a homologous ADAR protein.

In some embodiments, the adenosine deaminase comprises a mutation at any one or more of positions T375, V351, G478, S458, H460 of the hADAR2-D amino acid sequence, or a corresponding position in a homologous ADAR protein, optionally in combination a mutation at E488. In some embodiments, the adenosine deaminase comprises one or more of mutations selected from T375G, T375C, T375H, T375Q, V351M, V351T, V351Y, G478R, S458F, H460I, optionally in combination with E488Q.

In some embodiments, the adenosine deaminase comprises one or more of mutations selected from T375H, T375Q, V351M, V351Y, H460P, optionally in combination with E488Q.

In some embodiments, the adenosine deaminase comprises mutations T375S and S458F, optionally in combination with E488Q.

In some embodiments, the adenosine deaminase comprises a mutation at two or more of positions T375, N473, R474, G478, S458, P459, V351, R455, R455, T490, R348, Q479 of the hADAR2-D amino acid sequence, or a corresponding position in a homologous ADAR protein, optionally in combination a mutation at E488. In some embodiments, the adenosine deaminase comprises two or more of mutations selected from T375G, T375S, N473D, R474E, G478R, S458F, P459W, V351L, R455G, R455S, T490A, R348E, Q479P, optionally in combination with E488Q.

In some embodiments, the adenosine deaminase comprises mutations T375G and V351L. In some embodiments, the adenosine deaminase comprises mutations T375G and R455G. In some embodiments, the adenosine deaminase comprises mutations T375G and R455S. In some embodiments, the adenosine deaminase comprises mutations T375G and T490A. In some embodiments, the adenosine deaminase comprises mutations T375G and R348E. In some embodiments, the adenosine deaminase comprises mutations T375S and V351L. In some embodiments, the adenosine deaminase comprises mutations T375S and R455G. In some embodiments, the adenosine deaminase comprises mutations T375S and R455S. In some embodiments, the adenosine deaminase comprises mutations T375S and T490A. In some embodiments, the adenosine deaminase comprises mutations T375S and R348E. In some embodiments, the adenosine deaminase comprises mutations N473D and V351L. In some embodiments, the adenosine deaminase comprises mutations N473D and R455G. In some embodiments, the adenosine deaminase comprises mutations N473D and R455S. In some embodiments, the adenosine deaminase comprises mutations N473D and T490A. In some embodiments, the adenosine deaminase comprises mutations N473D and R348E. In some embodiments, the adenosine deaminase comprises mutations R474E and V351L. In some embodiments, the adenosine deaminase comprises mutations R474E and R455G. In some embodiments, the adenosine deaminase comprises mutations R474E and R455S. In some embodiments, the adenosine deaminase comprises mutations R474E and T490A. In some embodiments, the adenosine deaminase comprises mutations R474E and R348E. In some embodiments, the adenosine deaminase comprises mutations S458F and T375G. In some embodiments, the adenosine deaminase comprises mutations S458F and T375S. In some embodiments, the adenosine deaminase comprises mutations S458F and N473D. In some embodiments, the adenosine deaminase comprises mutations S458F and R474E. In some embodiments, the adenosine deaminase comprises mutations S458F and G478R. In some embodiments, the adenosine deaminase comprises mutations G478R and T375G. In some embodiments, the adenosine deaminase comprises mutations G478R and T375S. In some embodiments, the adenosine deaminase comprises mutations G478R and N473D. In some embodiments, the adenosine deaminase comprises mutations G478R and R474E. In some embodiments, the adenosine deaminase comprises mutations P459W and T375G. In some embodiments, the adenosine deaminase comprises mutations P459W and T375S. In some embodiments, the adenosine deaminase comprises mutations P459W and N473D. In some embodiments, the adenosine deaminase comprises mutations P459W and R474E. In some embodiments, the adenosine deaminase comprises mutations P459W and G478R. In some embodiments, the adenosine deaminase comprises mutations P459W and S458F. In some embodiments, the adenosine deaminase comprises mutations Q479P and T375G. In some embodiments, the adenosine deaminase comprises mutations Q479P and T375S. In some embodiments, the adenosine deaminase comprises mutations Q479P and N473D. In some embodiments, the adenosine deaminase comprises mutations Q479P and R474E. In some embodiments, the adenosine deaminase comprises mutations Q479P and G478R. In some embodiments, the adenosine deaminase comprises mutations Q479P and S458F. In some embodiments, the adenosine deaminase comprises mutations Q479P and P459W. All mutations described in this paragraph may also further be made in combination with a E488Q mutations.

In some embodiments, the adenosine deaminase comprises a mutation at any one or more of positions K475, Q479, P459, G478, S458 of the hADAR2-D amino acid sequence, or a corresponding position in a homologous ADAR protein, optionally in combination a mutation at E488. In some embodiments, the adenosine deaminase comprises one or more of mutations selected from K475N, Q479N, P459W, G478R, S458P, S458F, optionally in combination with E488Q.

In some embodiments, the adenosine deaminase comprises a mutation at any one or more of positions T375, V351, R455, H460, A476 of the hADAR2-D amino acid sequence, or a corresponding position in a homologous ADAR protein, optionally in combination a mutation at E488. In some embodiments, the adenosine deaminase comprises one or more of mutations selected from T375G, T375C, T375H, T375Q, V351M, V351T, V351Y, R455H, H460P, H460I, A476E, optionally in combination with E488Q.

In certain embodiments, improvement of editing and reduction of off-target modification is achieved by chemical modification of gRNAs. gRNAs which are chemically modified as exemplified in Vogel et al. (2014), Angew Chem Int Ed, 53:6267-6271, doi:10.1002/anie.201402634 (incorporated herein by reference in its entirety) reduce off-target activity and improve on-target efficiency. 2'-O-methyl and phosphothioate modified guide RNAs in general improve editing efficiency in cells.

ADAR has been known to demonstrate a preference for neighboring nucleotides on either side of the edited A (www.nature.com/nsmb/journal/v23/n5/full/nsmb.3203.html, Matthews et al. (2017), Nature Structural Mol Biol, 23(5): 426-433, incorporated herein by reference in its entirety). Accordingly, in certain embodiments, the gRNA, target, and/or ADAR is selected optimized for motif preference.

Intentional mismatches have been demonstrated in vitro to allow for editing of non-preferred motifs (academic.oup.com/nar/article-lookup/doi/10.1093/nar/gku272; Schneider et al (2014), Nucleic Acid Res, 42(10):e87); Fukuda et al. (2017), Scientific Reports, 7, doi:10.1038/srep41478, incorporated herein by reference in its entirety). Accordingly, in certain embodiments, to enhance RNA editing efficiency on non-preferred 5' or 3' neighboring bases, intentional mismatches in neighboring bases are introduced.

In some embodiments, the adenosine deaminase may be a tRNA-specific adenosine deaminase or a variant thereof. In some embodiments, the adenosine deaminase may comprise one or more of the mutations: W23L, W23R, R26G, H36L, N37S, P48S, P48T, P48A, I49V, R51L, N72D, L84F, S97C, A106V, D108N, H123Y, G125A, A142N, S146C, D147Y, R152H, R152P, E155V, I156F, K157N, K161T, based on amino acid sequence positions of *E. coli* TadA, and mutations in a homologous deaminase protein corresponding to the above. In some embodiments, the adenosine deaminase may comprise one or more of the mutations: D108N based on amino acid sequence positions of *E. coli* TadA, and mutations in a homologous deaminase protein corresponding to the above. In some embodiments, the adenosine deaminase may comprise one or more of the mutations: A106V, D108N, based on amino acid sequence positions of *E. coli* TadA, and mutations in a homologous deaminase protein corresponding to the above. In some embodiments, the adenosine deaminase may comprise one or more of the mutations: A106V, D108N, D147Y, E155V, based on amino acid sequence positions of *E. coli* TadA, and mutations in a homologous deaminase protein corresponding to the above. In some embodiments, the adenosine deaminase may comprise one or more of the mutations: A106V, D108N, based on amino acid sequence positions of *E. coli* TadA, and mutations in a homologous deaminase protein corresponding to the above. In some embodiments, the adenosine deaminase may comprise one or more of the mutations: A106V, D108N, D147Y, E155V, L84F, H123Y, I156F, based on amino acid sequence positions of *E. coli* TadA, and mutations in a homologous deaminase protein corresponding to the above. In some embodiments, the adenosine deaminase may comprise one or more of the mutations: A106V, D108N, D147Y, E155V, L84F, H123Y, I156F, A142N, based on amino acid sequence positions of *E. coli* TadA, and mutations in a homologous deaminase protein corresponding to the above. In some embodiments, the adenosine deaminase may comprise one or more of the mutations: A106V, D108N, D147Y, E155V, L84F, H123Y, I156F, H36L, R51L, S146C, K157N, based on amino acid sequence positions of *E. coli* TadA, and mutations in a homologous deaminase protein corresponding to the above. In some embodiments, the adenosine deaminase may comprise one or more of the mutations: A106V, D108N, D147Y, E155V, L84F, H123Y, I156F, H36L, R51L, S146C, K157N, P48S, based on amino acid sequence positions of *E. coli* TadA, and mutations in a homologous deaminase protein corresponding to the above. In some embodiments, the adenosine deaminase may comprise one or more of the mutations: A106V, D108N, D147Y, E155V, L84F, H123Y, I156F, H36L, R51L, S146C, K157N, P48S, A142N, based on amino acid sequence positions of *E. coli* TadA, and mutations in a homologous deaminase protein corresponding to the above. In some embodiments, the adenosine deaminase may comprise one or more of the mutations: A106V, D108N, D147Y, E155V, L84F, H123Y, I156F, H36L, R51L, S146C, K157N, P48S, W23R, P48A, based on amino acid sequence positions of *E. coli* TadA, and mutations in a homologous deaminase protein corresponding to the above. In some embodiments, the adenosine deaminase may comprise one or more of the mutations: A106V, D108N, D147Y, E155V, L84F, H123Y, I156F, H36L, R51L, S146C, K157N, P48S, W23R, P48A, A142N, based on amino acid sequence positions of *E. coli* TadA, and mutations in a homologous deaminase protein corresponding to the above. In some embodiments, the adenosine deaminase may comprise one or more of the mutations: A106V, D108N, D147Y, E155V, L84F, H123Y, I156F, H36L, R51L, S146C, K157N, P48S, W23R, P48A, R152P, based on amino acid sequence positions of *E. coli* TadA, and mutations in a homologous deaminase protein corresponding to the above. In some embodiments, the adenosine deaminase may comprise one or more of the mutations: A106V, D108N, D147Y, E155V, L84F, H123Y, I156F, H36L, R51L, S146C, K157N, P48S, W23R, P48A, R152P, A142N, based on amino acid sequence positions of *E. coli* TadA, and mutations in a homologous deaminase protein corresponding to the above.

Results suggest that A's opposite C's in the targeting window of the ADAR deaminase domain are preferentially edited over other bases. Additionally, A's base-paired with U's within a few bases of the targeted base show low levels of editing by CRISPR-Cas-ADAR fusions, suggesting that there is flexibility for the enzyme to edit multiple A's. These two observations suggest that multiple A's in the activity window of CRISPR-Cas-ADAR fusions could be specified for editing by mismatching all A's to be edited with C's. Accordingly, in certain embodiments, multiple A:C mismatches in the activity window are designed to create multiple A:I edits. In certain embodiments, to suppress potential off-target editing in the activity window, non-target A's are paired with A's or G's.

The terms "editing specificity" and "editing preference" are used interchangeably herein to refer to the extent of A-to-I editing at a particular adenosine site in a double-stranded substrate. In some embodiment, the substrate editing preference is determined by the 5' nearest neighbor and/or the 3' nearest neighbor of the target adenosine residue. In some embodiments, the adenosine deaminase has preference for the 5' nearest neighbor of the substrate ranked as U>A>C>G (">" indicates greater preference). In some embodiments, the adenosine deaminase has preference for the 3' nearest neighbor of the substrate ranked as G>C~A>U (">" indicates greater preference; "~" indicates similar preference). In some embodiments, the adenosine deaminase has preference for the 3' nearest neighbor of the substrate ranked as G>C>U~A (">" indicates greater preference; "~" indicates similar preference). In some embodiments, the adenosine deaminase has preference for the 3' nearest neighbor of the substrate ranked as G>C>A>U (">" indicates greater preference). In some embodiments, the adenosine deaminase has preference for the 3' nearest neighbor of the substrate ranked as C~G~A>U (">" indicates greater preference; "~" indicates similar preference). In some embodiments, the adenosine deaminase has preference for a triplet sequence containing the target adenosine residue ranked as TAG>AAG>CAC>AAT>GAA>GAC (">" indicates greater preference), the center A being the target adenosine residue.

In some embodiments, the substrate editing preference of an adenosine deaminase is affected by the presence or absence of a nucleic acid binding domain in the adenosine deaminase protein. In some embodiments, to modify substrate editing preference, the deaminase domain is connected with a double-strand RNA binding domain (dsRBD) or a double-strand RNA binding motif (dsRBM). In some embodiments, the dsRBD or dsRBM may be derived from an ADAR protein, such as hADAR1 or hADAR2. In some embodiments, a full length ADAR protein that comprises at least one dsRBD and a deaminase domain is used. In some embodiments, the one or more dsRBM or dsRBD is at the N-terminus of the deaminase domain. In other embodiments, the one or more dsRBM or dsRBD is at the C-terminus of the deaminase domain.

In some embodiments, the substrate editing preference of an adenosine deaminase is affected by amino acid residues near or in the active center of the enzyme. In some embodiments, to modify substrate editing preference, the adenosine deaminase may comprise one or more of the mutations: G336D, G487R, G487K, G487W, G487Y, E488Q, E488N, T490A, V493A, V493T, V493S, N597K, N597R, A589V, S599T, N613K, N613R, based on amino acid sequence positions of hADAR2-D, and mutations in a homologous ADAR protein corresponding to the above.

Particularly, in some embodiments, to reduce editing specificity, the adenosine deaminase can comprise one or more of mutations E488Q, V493A, N597K, N613K, based on amino acid sequence positions of hADAR2-D, and mutations in a homologous ADAR protein corresponding to the above. In some embodiments, to increase editing specificity, the adenosine deaminase can comprise mutation T490A.

In some embodiments, to increase editing preference for target adenosine (A) with an immediate 5' G, such as substrates comprising the triplet sequence GAC, the center A being the target adenosine residue, the adenosine deaminase can comprise one or more of mutations G336D, E488Q, E488N, V493T, V493S, V493A, A589V, N597K, N597R, S599T, N613K, N613R, based on amino acid sequence positions of hADAR2-D, and mutations in a homologous ADAR protein corresponding to the above.

Particularly, in some embodiments, the adenosine deaminase comprises mutation E488Q or a corresponding mutation in a homologous ADAR protein for editing substrates comprising the following triplet sequences: GAC, GAA, GAU, GAG, CAU, AAU, UAC, the center A being the target adenosine residue.

In some embodiments, the adenosine deaminase comprises the wild-type amino acid sequence of hADAR1-D. In some embodiments, the adenosine deaminase comprises one or more mutations in the hADAR1-D sequence, such that the editing efficiency, and/or substrate editing preference of hADAR1-D is changed according to specific needs.

In some embodiments, the adenosine deaminase comprises a mutation at Glycine1007 of the hADAR1-D amino acid sequence, or a corresponding position in a homologous ADAR protein. In some embodiments, the glycine residue at position 1007 is replaced by a non-polar amino acid residue with relatively small side chains. For example, in some embodiments, the glycine residue at position 1007 is replaced by an alanine residue (G1007A). In some embodiments, the glycine residue at position 1007 is replaced by a valine residue (G1007V). In some embodiments, the glycine residue at position 1007 is replaced by an amino acid residue with relatively large side chains. In some embodiments, the glycine residue at position 1007 is replaced by an arginine residue (G1007R). In some embodiments, the glycine residue at position 1007 is replaced by a lysine residue (G1007K). In some embodiments, the glycine residue at position 1007 is replaced by a tryptophan residue (G1007W). In some embodiments, the glycine residue at position 1007 is replaced by a tyrosine residue (G1007Y). Additionally, in other embodiments, the glycine residue at position 1007 is replaced by a leucine residue (G1007L). In other embodiments, the glycine residue at position 1007 is replaced by a threonine residue (G1007T). In other embodiments, the glycine residue at position 1007 is replaced by a serine residue (G1007S).

In some embodiments, the adenosine deaminase comprises a mutation at glutamic acid1008 of the hADAR1-D amino acid sequence, or a corresponding position in a homologous ADAR protein. In some embodiments, the glutamic acid residue at position 1008 is replaced by a polar amino acid residue having a relatively large side chain. In some embodiments, the glutamic acid residue at position 1008 is replaced by a glutamine residue (E1008Q). In some embodiments, the glutamic acid residue at position 1008 is replaced by a histidine residue (E1008H). In some embodiments, the glutamic acid residue at position 1008 is replaced by an arginine residue (E1008R). In some embodiments, the glutamic acid residue at position 1008 is replaced by a lysine residue (E1008K). In some embodiments, the glutamic acid residue at position 1008 is replaced by a nonpolar or small polar amino acid residue. In some embodiments, the glutamic acid residue at position 1008 is replaced by a phenylalanine residue (E1008F). In some embodiments, the glutamic acid residue at position 1008 is replaced by a tryptophan residue (E1008W). In some embodiments, the glutamic acid residue at position 1008 is replaced by a glycine residue (E1008G). In some embodiments, the glutamic acid residue at position 1008 is replaced by an isoleucine residue (E1008I). In some embodiments, the glutamic acid residue at position 1008 is replaced by a valine residue (E1008V). In some embodiments, the glutamic acid residue at position 1008 is replaced by a proline residue (E1008P). In some embodiments, the glutamic acid residue at position 1008 is replaced by a serine residue (E1008S). In other embodiments, the glutamic acid residue at position 1008 is replaced by an asparagine residue (E1008N). In other embodiments, the glutamic acid residue at position 1008 is replaced by an alanine residue (E1008A). In other embodiments, the glutamic acid residue at position 1008 is replaced by a Methionine residue (E1008M). In some embodiments, the glutamic acid residue at position 1008 is replaced by a leucine residue (E1008L).

In some embodiments, to improve editing efficiency, the adenosine deaminase may comprise one or more of the mutations: E1007S, E1007A, E1007V, E1008Q, E1008R, E1008H, E1008M, E1008N, E1008K, based on amino acid sequence positions of hADAR1-D, and mutations in a homologous ADAR protein corresponding to the above.

In some embodiments, to reduce editing efficiency, the adenosine deaminase may comprise one or more of the mutations: E1007R, E1007K, E1007Y, E1007L, E1007T, E1008G, E1008I, E1008P, E1008V, E1008F, E1008W, E1008S, E1008N, E1008K, based on amino acid sequence positions of hADAR1-D, and mutations in a homologous ADAR protein corresponding to the above.

In some embodiments, the substrate editing preference, efficiency and/or selectivity of an adenosine deaminase is affected by amino acid residues near or in the active center of the enzyme. In some embodiments, the adenosine deaminase comprises a mutation at the glutamic acid 1008 position in hADAR1-D sequence, or a corresponding position in a homologous ADAR protein. In some embodiments, the mutation is E1008R, or a corresponding mutation in a homologous ADAR protein. In some embodiments, the E1008R mutant has an increased editing efficiency for target adenosine residue that has a mismatched G residue on the opposite strand.

In some embodiments, the adenosine deaminase protein further comprises or is connected to one or more double-stranded RNA (dsRNA) binding motifs (dsRBMs) or domains (dsRBDs) for recognizing and binding to double-stranded nucleic acid substrates. In some embodiments, the interaction between the adenosine deaminase and the double-stranded substrate is mediated by one or more additional protein factor(s), including a CRISPR/CAS protein factor. In some embodiments, the interaction between the adenosine deaminase and the double-stranded substrate is further mediated by one or more nucleic acid component(s), including a guide RNA.

In certain example embodiments, directed evolution may be used to design modified ADAR proteins capable of catalyzing additional reactions besides deamination of a adenine to a hypoxanthine.

Modified Adenosine Deaminase Having C to U Deamination Activity

In certain example embodiments, directed evolution may be used to design modified ADAR proteins capable of catalyzing additional reactions besides deamination of an adenine to a hypoxanthine. For example, the modified ADAR protein may be capable of catalyzing deamination of a cytidine to a uracil. While not bound by a particular theory, mutations that improve C to U activity may alter the shape of the binding pocket to be more amenable to the smaller cytidine base. In some cases, the modified ADAR comprise mutations on residues the catalytic core and/or residues that contact the RNA target. Examples of mutations on residues in the catalytic core include V351G and K350I., based on amino acid sequence positions of hADAR2-D, and mutations in a homologous ADAR protein corresponding to the above. Examples of mutations on residues on the residues that contact with the RNA target include S486A and S495N, based on amino acid sequence positions of hADAR2-D, and mutations in a homologous ADAR protein corresponding to the above.

In certain embodiments the adenosine deaminase is engineered to convert the activity to cytidine deaminase. Such engineered adenosine deaminase may also retain its adenosine deaminase activity, i.e., such mutated adenosine deaminase may have both adenosine deaminase and cytidine deaminase activities. Accordingly in some embodiments, the adenosine deaminase comprises one or more mutations in positions selected from E396, C451, V351, R455, T375, K376, S486, Q488, R510, K594, R348, G593, S397, H443, L444, Y445, F442, E438, T448, A353, V355, T339, P539, T339, P539, V525 I520, P462 and N579. In particular embodiments, the adenosine deaminase comprises one or more mutations in a position selected from V351, L444, V355, V525 and I520. In some embodiments, the adenosine deaminase may comprise one or more of mutations at E488, V351, S486, T375, S370, P462, N597, based on amino acid sequence positions of hADAR2-D, and mutations in a homologous ADAR protein corresponding to the above.

In some embodiments, the adenosine deaminase may comprise one or more of the mutations: E488Q based on amino acid sequence positions of hADAR2-D, and mutations in a homologous ADAR protein corresponding to the above. In some embodiments, the adenosine deaminase may comprise one or more of the mutations: E488Q, V351G, based on amino acid sequence positions of hADAR2-D, and mutations in a homologous ADAR protein corresponding to the above. In some embodiments, the adenosine deaminase may comprise one or more of the mutations: E488Q, V351G, S486A, based on amino acid sequence positions of hADAR2-D, and mutations in a homologous ADAR protein corresponding to the above. In some embodiments, the adenosine deaminase may comprise one or more of the mutations: E488Q, V351G, S486A, T375S, based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, P462A, based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, P462A, N597I, based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, P462A, N597I, L332I, based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, P462A, N597I, L332I, I398V, based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, P462A, N597I, L332I, I398V, K350I, based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, P462A, N597I, L332I, I398V, K350I, M383L, based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, P462A, N597I, L332I, I398V, K350I, M383L, D619G, based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, P462A, N597I, L332I, I398V, K350I, M383L, D619G, S582T, based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, P462A, N597I, L332I, I398V, K350I, M383L, D619G, S582T, V440I based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, P462A, N597I, L332I, I398V, K350I, M383L, D619G, S582T, V440I, S495N based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, P462A, N597I, L332I, I398V, K350I, M383L, D619G, S582T, V440I, S495N, K418E based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, P462A, N597I, L332I, I398V, K350I, M383L, D619G, S582T, V440I, S495N, K418E, S661T based on amino acid sequence positions of hADAR2-D, and mutations in a homologous ADAR protein corresponding to the above. In some examples, provided herein includes a mutated adenosine deaminase e.g., an adenosine deaminase comprising one or more mutations of E488Q, V351G, S486A, T375S, S370C, P462A, N597I, L332I, I398V, K350I, M383L, D619G, S582T, V440I, S495N, K418E, S661T (based on amino acid sequence positions of hADAR2-D, and mutations in a homologous ADAR protein corresponding to the above), fused with a dead CRISPR-Cas protein or CRISPR-Cas nickase. In a particular example, provided herein includes a mutated adenosine deaminase e.g., an adenosine deaminase comprising E488Q, V351G, S486A, T375S, S370C, P462A, N597I, L332I, I398V, K350I, M383L, D619G, S582T, V440I, S495N, K418E, and S661T (based on amino acid sequence positions of hADAR2-D, and mutations in a homologous ADAR protein corresponding to the above), fused with a dead CRISPR-Cas protein or a CRISPR-Cas nickase.

In some embodiments, the modified adenosine deaminase having C-to-U deamination activity comprises a mutation at any one or more of positions V351, T375, R455, and E488 of the hADAR2-D amino acid sequence, or a corresponding position in a homologous ADAR protein. In some embodiments, the adenosine deaminase comprises mutation E488Q. In some embodiments, the adenosine deaminase comprises one or more of mutations selected from V351I, V351L, V351F, V351M, V351C, V351A, V351G, V351P, V351T, V351S, V351Y, V351W, V351Q, V351N, V351H, V351E, V351D, V351K, V351R, T375I, T375L, T375V, T375F, T375M, T375C, T375A, T375G, T375P, T375S, T375Y, T375W, T375Q, T375N, T375H, T375E, T375D, T375K, T375R, R455I, R455L, R455V, R455F, R455M, R455C, R455A, R455G, R455P, R455T, R455S, R455Y, R455W, R455Q, R455N, R455H, R455E, R455D, R455K. In some embodiments, the adenosine deaminase comprises mutation E488Q, and further comprises one or more of mutations selected from V351I, V351L, V351F, V351M, V351C, V351A, V351G, V351P, V351T, V351S, V351Y, V351W, V351Q, V351N, V351H, V351E, V351D, V351K, V351R, T375I, T375L, T375V, T375F, T375M, T375C, T375A, T375G, T375P, T375S, T375Y, T375W, T375Q, T375N, T375H, T375E, T375D, T375K, T375R, R455I, R455L, R455V, R455F, R455M, R455C, R455A, R455G, R455P, R455T, R455S, R455Y, R455W, R455Q, R455N, R455H, R455E, R455D, R455K.

In some cases, the modified ADAR may further comprise one or more mutations that reduce off-target activities. In cases where modified ADAR has C-to-U deamination activity, such mutations may reduce A to I off-target activity and increase C-to-U on-target deamination activity. In general, such mutations may be on residues that interact with the RNA target. Examples of such mutations include S375N, S375C, S375A, and N473I, based on amino acid sequence positions of hADAR2-D, and mutations in a homologous ADAR protein corresponding to the above. In one example, the ADAR has S375N mutation. In one example, provided herein includes a mutated adenosine deaminase e.g., an adenosine deaminase comprising E488Q, V351G, S486A, T375S, S370C, P462A, N597I, L332I, I398V, K350I, M383L, D619G, S582T, V440I, S495N, K418E, S661T, and S375N (based on amino acid sequence positions of hADAR2-D, and mutations in a homologous ADAR protein corresponding to the above), fused with a dead CRISPR-Cas protein or a CRISPR-Cas nickase.

In connection with the aforementioned modified ADAR protein having C-to-U deamination activity, the invention described herein also relates to a method for deaminating a C in a target RNA sequence of interest, comprising delivering to a target RNA or DNA an AD-functionalized composition disclosed herein.

In certain example embodiments, the method for deaminating a C in a target RNA sequence comprising delivering to said target RNA: (a) a catalytically inactive (dead) Cas; (b) a guide molecule which comprises a guide sequence linked to a direct repeat sequence; and (c) a modified ADAR protein having C-to-U deamination activity or catalytic domain thereof, wherein said modified ADAR protein or catalytic domain thereof is covalently or non-covalently linked to said dead Cas protein or said guide molecule or is adapted to link thereto after delivery; wherein guide molecule forms a complex with said dead Cas protein and directs said complex to bind said target RNA sequence of interest; wherein said guide sequence is capable of hybridizing with a target sequence comprising said C to form an RNA duplex; wherein, optionally, said guide sequence comprises a non-pairing A or U at a position corresponding to said C resulting in a mismatch in the RNA duplex formed; and wherein said modified ADAR protein or catalytic domain thereof deaminates said C in said RNA duplex.

In connection with the aforementioned modified ADAR protein having C-to-U deamination activity, the invention described herein further relates to an engineered, non-naturally occurring system suitable for deaminating a C in a target locus of interest, comprising: (a) a guide molecule which comprises a guide sequence linked to a direct repeat sequence, or a nucleotide sequence encoding said guide molecule; (b) a catalytically inactive CRISPR-Cas protein, or a nucleotide sequence encoding said catalytically inactive CRISPR-Cas protein; (c) a modified ADAR protein having C-to-U deamination activity or catalytic domain thereof, or a nucleotide sequence encoding said modified ADAR protein or catalytic domain thereof, wherein said modified ADAR protein or catalytic domain thereof is covalently or non-covalently linked to said CRISPR-Cas protein or said guide molecule or is adapted to link thereto after delivery; wherein said guide sequence is capable of hybridizing with a target RNA sequence comprising a C to form an RNA duplex; wherein, optionally, said guide sequence comprises a non-pairing A or U at a position corresponding to said C resulting in a mismatch in the RNA duplex formed; wherein, optionally, the system is a vector system comprising one or more vectors comprising: (a) a first regulatory element operably linked to a nucleotide sequence encoding said guide molecule which comprises said guide sequence, (b) a second regulatory element operably linked to a nucleotide sequence encoding said catalytically inactive CRISPR-Cas protein; and (c) a nucleotide sequence encoding a modified ADAR protein having C-to-U deamination activity or catalytic domain thereof which is under control of said first or second regulatory element or operably linked to a third regulatory element; wherein, if said nucleotide sequence encoding a modified ADAR protein or catalytic domain thereof is operably linked to a third regulatory element, said modified ADAR protein or catalytic domain thereof is adapted to link to said guide molecule or said CRISPR-Cas protein after expression; wherein components (a), (b) and (c) are located on the same or different vectors of the system, optionally wherein said first, second, and/or third regulatory element is an inducible promoter.

In an embodiment of the invention, the substrate of the adenosine deaminase is an RNA/DNA heteroduplex formed upon binding of the guide molecule to its DNA target which then forms the CRISPR-Cas complex with the CRISPR-Cas enzyme. The RNA/DNA or DNA/RNA heteroduplex is also referred to herein as the "RNA/DNA hybrid", "DNA/RNA hybrid" or "double-stranded substrate".

According to the present invention, the substrate of the adenosine deaminase is an RNA/DNAn RNA duplex formed upon binding of the guide molecule to its DNA target which then forms the CRISPR-Cas complex with the CRISPR-Cas enzyme. The substrate of the adenosine deaminase can also be an RNA/RNA duplex formed upon binding of the guide molecule to its RNA target which then forms the CRISPR-Cas complex with the CRISPR-Cas enzyme. The RNA/DNA or DNA/RNAn RNA duplex is also referred to herein as the "RNA/DNA hybrid", "DNA/RNA hybrid" or "double-stranded substrate". The particular features of the guide molecule and CRISPR-Cas enzyme are detailed below.

The term "editing selectivity" as used herein refers to the fraction of all sites on a double-stranded substrate that is edited by an adenosine deaminase. Without being bound by theory, it is contemplated that editing selectivity of an adenosine deaminase is affected by the double-stranded substrate's length and secondary structures, such as the presence of mismatched bases, bulges and/or internal loops.

In some embodiments, when the substrate is a perfectly base-paired duplex longer than 50 bp, the adenosine deaminase may be able to deaminate multiple adenosine residues within the duplex (e.g., 50% of all adenosine residues). In some embodiments, when the substrate is shorter than 50 bp, the editing selectivity of an adenosine deaminase is affected by the presence of a mismatch at the target adenosine site. Particularly, in some embodiments, adenosine (A) residue having a mismatched cytidine (C) residue on the opposite strand is deaminated with high efficiency. In some embodiments, adenosine (A) residue having a mismatched guanosine (G) residue on the opposite strand is skipped without editing.

In particular embodiments, the adenosine deaminase protein or catalytic domain thereof is delivered to the cell or expressed within the cell as a separate protein, but is modified so as to be able to link to either the Cas protein or the guide molecule. In particular embodiments, this is ensured by the use of orthogonal RNA-binding protein or adaptor protein/aptamer combinations that exist within the diversity of bacteriophage coat proteins. Examples of such coat proteins include but are not limited to: MS2, Qβ, F2, GA, fr, JP501, M12, R17, BZ13, JP34, JP500, KU1, M11, MX1, TW18, VK, SP, FI, ID2, NL95, TW19, AP205, ϕCb5, ϕCb8r, ϕCb12r, ϕCb23r, 7s and PRR1. Aptamers can be naturally occurring or synthetic oligonucleotides that have been engineered through repeated rounds of in vitro selection or SELEX (systematic evolution of ligands by exponential enrichment) to bind to a specific target.

In particular embodiments, the guide molecule is provided with one or more distinct RNA loop(s) or distinct sequence(s) that can recruit an adaptor protein. A guide molecule may be extended, without colliding with the Cas protein by the insertion of distinct RNA loop(s) or distinct sequence(s) that may recruit adaptor proteins that can bind to the distinct RNA loop(s) or distinct sequence(s). Examples of modified guides and their use in recruiting effector domains to the Cas complex are provided in Konermann (Nature 2015, 517(7536): 583-588). In particular embodiments, the aptamer is a minimal hairpin aptamer which selectively binds dimerized MS2 bacteriophage coat proteins in mammalian cells and is introduced into the guide molecule, such as in the stemloop and/or in a tetraloop. In these embodiments, the adenosine deaminase protein is fused to MS2. The adenosine deaminase protein is then co-delivered together with the Cas protein and corresponding guide RNA.

In some embodiments, the Cas-ADAR base editing system described herein comprises (a) a Cas protein, which is catalytically inactive or a nickase; (b) a guide molecule which comprises a guide sequence; and (c) an adenosine deaminase protein or catalytic domain thereof; wherein the adenosine deaminase protein or catalytic domain thereof is covalently or non-covalently linked to the Cas protein or the guide molecule or is adapted to link thereto after delivery; wherein the guide sequence is substantially complementary to the target sequence but comprises a non-pairing C corresponding to the A being targeted for deamination, resulting in a A-C mismatch in a DNA-RNA or RNA-RNA duplex formed by the guide sequence and the target sequence. For application in eukaryotic cells, the Cas protein and/or the adenosine deaminase are preferably NLS-tagged.

In some embodiments, the components (a), (b) and (c) are delivered to the cell as a ribonucleoprotein complex. The ribonucleoprotein complex can be delivered via one or more lipid nanoparticles.

In some embodiments, the components (a), (b) and (c) are delivered to the cell as one or more RNA molecules, such as one or more guide RNAs and one or more mRNA molecules encoding the Cas protein, the adenosine deaminase protein, and optionally the adaptor protein. The RNA molecules can be delivered via one or more lipid nanoparticles.

In some embodiments, the components (a), (b) and (c) are delivered to the cell as one or more DNA molecules. In some embodiments, the one or more DNA molecules are comprised within one or more vectors such as viral vectors (e.g., AAV). In some embodiments, the one or more DNA molecules comprise one or more regulatory elements operably configured to express the Cas protein, the guide molecule, and the adenosine deaminase protein or catalytic domain thereof, optionally wherein the one or more regulatory elements comprise inducible promoters.

In some embodiments of the guide molecule is capable of hybridizing with a target sequence comprising the Adenine to be deaminated within a first DNA strand or a RNA strand at the target locus to form a DNA-RNA or RNA-RNA duplex which comprises a non-pairing Cytosine opposite to said Adenine. Upon duplex formation, the guide molecule forms a complex with the Cas protein and directs the complex to bind said first DNA strand or said RNA strand at the target locus of interest. Details on the aspect of the guide of the Cas-ADAR base editing system are provided herein below.

In some embodiments, a Cas guide RNA having a canonical length (e.g., about 20 nt for AacCas) is used to form a DNA-RNA or RNA-RNA duplex with the target DNA or RNA. In some embodiments, a Cas guide molecule longer than the canonical length (e.g., >20 nt for AacCas) is used to form a DNA-RNA or RNA-RNA duplex with the target DNA or RNA including outside of the Cas-guide RNA-target DNA complex. In certain example embodiments, the guide sequence has a length of about 29-53 nt capable of forming a DNA-RNA or RNA-RNA duplex with said target sequence. In certain other example embodiments, the guide sequence has a length of about 40-50 nt capable of forming a DNA-RNA or RNA-RNA duplex with said target sequence. In certain example embodiments, the distance between said non-pairing C and the 5' end of said guide sequence is 20-30 nucleotides. In certain example embodiments, the distance between said non-pairing C and the 3' end of said guide sequence is 20-30 nucleotides.

In at least a first design, the Cas-ADAR system comprises (a) an adenosine deaminase fused or linked to a Cas protein, wherein the Cas protein is catalytically inactive or a nickase, and (b) a guide molecule comprising a guide sequence designed to introduce a A-C mismatch in a DNA-RNA or RNA-RNA duplex formed between the guide sequence and the target sequence. In some embodiments, the Cas protein and/or the adenosine deaminase are NLS-tagged, on either the N- or C-terminus or both.

In at least a second design, the Cas-ADAR system comprises (a) a Cas protein that is catalytically inactive or a nickase, (b) a guide molecule comprising a guide sequence designed to introduce a A-C mismatch in a DNA-RNA or RNA-RNA duplex formed between the guide sequence and the target sequence, and an aptamer sequence (e.g., MS2 RNA motif or PP7 RNA motif) capable of binding to an adaptor protein (e.g., MS2 coating protein or PP7 coat protein), and (c) an adenosine deaminase fused or linked to an adaptor protein, wherein the binding of the aptamer and the adaptor protein recruits the adenosine deaminase to the DNA-RNA or RNA-RNA duplex formed between the guide sequence and the target sequence for targeted deamination at the A of the A-C mismatch. In some embodiments, the adaptor protein and/or the adenosine deaminase are NLS-tagged, on either the N- or C-terminus or both. The Cas protein can also be NLS-tagged.

The use of different aptamers and corresponding adaptor proteins also allows orthogonal gene editing to be implemented. In one example in which adenosine deaminase are used in combination with cytidine deaminase for orthogonal gene editing/deamination, sgRNA targeting different loci are modified with distinct RNA loops in order to recruit MS2-adenosine deaminase and PP7-cytidine deaminase (or PP7-adenosine deaminase and MS2-cytidine deaminase), respectively, resulting in orthogonal deamination of A or C at the target loci of interested, respectively. PP7 is the RNA-binding coat protein of the bacteriophage *Pseudomonas*. Like MS2, it binds a specific RNA sequence and secondary structure. The PP7 RNA-recognition motif is distinct from that of MS2. Consequently, PP7 and MS2 can be multiplexed to mediate distinct effects at different genomic loci simultaneously. For example, an sgRNA targeting locus A can be modified with MS2 loops, recruiting MS2-adenosine deaminase, while another sgRNA targeting locus B can be modified with PP7 loops, recruiting PP7-cytidine deaminase. In the same cell, orthogonal, locus-specific modifications are thus realized. This principle can be extended to incorporate other orthogonal RNA-binding proteins.

In at least a third design, the Cas-ADAR CRISPR system comprises (a) an adenosine deaminase inserted into an internal loop or unstructured region of a Cas protein, wherein the Cas protein is catalytically inactive or a nickase, and (b) a guide molecule comprising a guide sequence designed to introduce a A-C mismatch in a DNA-RNA or RNA-RNA duplex formed between the guide sequence and the target sequence.

Cas protein split sites that are suitable for insertion of adenosine deaminase can be identified with the help of a crystal structure. For example, with respect to AacCas mutants, it should be readily apparent what the corresponding position for, for example, a sequence alignment. For other Cas protein one can use the crystal structure of an ortholog if a relatively high degree of homology exists between the ortholog and the intended Cas protein.

The split position may be located within a region or loop. Preferably, the split position occurs where an interruption of the amino acid sequence does not result in the partial or full destruction of a structural feature (e.g. alpha-helixes or β-sheets). Unstructured regions (regions that did not show up in the crystal structure because these regions are not structured enough to be "frozen" in a crystal) are often preferred options. Splits in all unstructured regions that are exposed on the surface of Cas are envisioned in the practice of the invention. The positions within the unstructured regions or outside loops may not need to be exactly the numbers provided above, but may vary by, for example 1, 2, 3, 4, 5, 6, 7, 8, 9, or even 10 amino acids either side of the position given above, depending on the size of the loop, so long as the split position still falls within an unstructured region of outside loop.

The Cas-ADAR system described herein can be used to target a specific Adenine within a DNA sequence for deamination. For example, the guide molecule can form a complex with the Cas protein and directs the complex to bind a target sequence at the target locus of interest. Because the guide sequence is designed to have a non-pairing C, the heteroduplex formed between the guide sequence and the target sequence comprises a A-C mismatch, which directs the adenosine deaminase to contact and deaminate the A opposite to the non-pairing C, converting it to a Inosine (I). Since Inosine (I) base pairs with C and functions like G in cellular process, the targeted deamination of A described herein are useful for correction of undesirable G-A and C-T mutations, as well as for obtaining desirable A-G and T-C mutations. In some embodiments, the guide may comprise one or more mismatches to increase specificity. For example, the guide may comprise one or more disfavorable guanine mismatches across from off-target adenosines.

Base Excision Repair Inhibitor

In some embodiments, the AD-functionalized CRISPR system further comprises a base excision repair (BER) inhibitor. Without wishing to be bound by any particular theory, cellular DNA-repair response to the presence of I:T pairing may be responsible for a decrease in nucleobase editing efficiency in cells. Alkyladenine DNA glycosylase (also known as DNA-3-methyladenine glycosylase, 3-alkyladenine DNA glycosylase, or N-methylpurine DNA glycosylase) catalyzes removal of hypoxanthine from DNA in cells, which may initiate base excision repair, with reversion of the I:T pair to a A:T pair as outcome.

In some embodiments, the BER inhibitor is an inhibitor of alkyladenine DNA glycosylase. In some embodiments, the BER inhibitor is an inhibitor of human alkyladenine DNA glycosylase. In some embodiments, the BER inhibitor is a polypeptide inhibitor. In some embodiments, the BER inhibitor is a protein that binds hypoxanthine. In some embodiments, the BER inhibitor is a protein that binds hypoxanthine in DNA. In some embodiments, the BER inhibitor is a catalytically inactive alkyladenine DNA glycosylase protein or binding domain thereof. In some embodiments, the BER inhibitor is a catalytically inactive alkyladenine DNA glycosylase protein or binding domain thereof that does not excise hypoxanthine from the DNA. Other proteins that are capable of inhibiting (e.g., sterically blocking) an alkyladenine DNA glycosylase base-excision repair enzyme are within the scope of this disclosure. Additionally, any proteins that block or inhibit base-excision repair as also within the scope of this disclosure.

Without wishing to be bound by any particular theory, base excision repair may be inhibited by molecules that bind the edited strand, block the edited base, inhibit alkyladenine DNA glycosylase, inhibit base excision repair, protect the edited base, and/or promote fixing of the non-edited strand. It is believed that the use of the BER inhibitor described herein can increase the editing efficiency of an adenosine deaminase that is capable of catalyzing a A to I change.

Accordingly, in the first design of the AD-functionalized CRISPR system discussed above, the CRISPR-Cas protein or the adenosine deaminase can be fused to or linked to a BER inhibitor (e.g., an inhibitor of alkyladenine DNA glycosylase). In some embodiments, the BER inhibitor can be comprised in one of the following structures (nCas=Cas nickase; dCas=dead Cas): [AD]-[optional linker]-[nCas/dCas]-[optional linker]-[BER inhibitor]; [AD]-[optional linker]-[BER inhibitor]-[optional linker]-[nCas/dCas]; [BER inhibitor]-[optional linker]-[AD]-[optional linker]-[nCas/dCas]; [BER inhibitor]-[optional linker]-[nCas/dCas]-[optional linker]-[AD]; [nCas/dCas]-[optional linker]-[AD]-[optional linker]-[BER inhibitor]; [nCas/dCas]-[optional linker]-[BER inhibitor]-[optional linker]-[AD].

Similarly, in the second design of the AD-functionalized CRISPR system discussed above, the CRISPR-Cas protein, the adenosine deaminase, or the adaptor protein can be fused to or linked to a BER inhibitor (e.g., an inhibitor of alkyladenine DNA glycosylase). In some embodiments, the BER inhibitor can be comprised in one of the following structures (nCas=Cas nickase; dCas=dead Cas): [nCas/dCas]-[optional linker]-[BER inhibitor]; [BER inhibitor]-[optional linker]-[nCas/dCas]; [AD]-[optional linker]-[Adaptor]-[optional linker]-[BER inhibitor]; [AD]-[optional linker]-[BER inhibitor]-[optional linker]-[Adaptor]; [BER inhibitor]-[optional linker]-[AD]-[optional linker]-[Adaptor]; [BER inhibitor]-[optional linker]-[Adaptor]-[optional linker]-[AD]; [Adaptor]-[optional linker]-[AD]-[optional linker]-[BER inhibitor]; [Adaptor]-[optional linker]-[BER inhibitor]-[optional linker]-[AD].

In the third design of the AD-functionalized CRISPR system discussed above, the BER inhibitor can be inserted into an internal loop or unstructured region of a CRISPR-Cas protein.

Cytidine Deaminase

In some embodiments, the deaminase is a cytidine deaminase. The term "cytidine deaminase" or "cytidine deaminase protein" or "cytidine deaminase activity" as used herein refers to a protein, a polypeptide, or one or more functional domain(s) of a protein or a polypeptide that is capable of catalyzing a hydrolytic deamination reaction that converts an cytosine (or an cytosine moiety of a molecule) to an uracil (or a uracil moiety of a molecule), as shown below. In some embodiments, the cytosine-containing molecule is an cytidine (C), and the uracil-containing molecule is an uridine (U). The cytosine-containing molecule can be deoxyribonucleic acid (DNA) or ribonucleic acid (RNA). In certain examples, a cytidine deaminase may be a cytidine deaminase acting on RNA (CDAR).

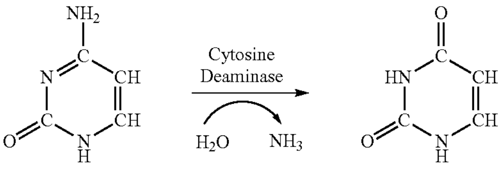

Cytosine (4-amino-2-oxopyrimidine)

Uracil (2,4-dioxopyrimidine)

According to the present disclosure, cytidine deaminases that can be used in connection with the present disclosure include, but are not limited to, members of the enzyme family known as apolipoprotein B mRNA-editing complex (APOBEC) family deaminase, an activation-induced deaminase (AID), or a cytidine deaminase 1 (CDA1). In particular embodiments, the deaminase in an APOBEC1 deaminase, an APOBEC2 deaminase, an APOBEC3A deaminase, an APOBEC3B deaminase, an APOBEC3C deaminase, and APOBEC3D deaminase, an APOBEC3E deaminase, an APOBEC3F deaminase an APOBEC3G deaminase, an APOBEC3H deaminase, or an APOBEC4 deaminase.

In the methods and systems of the present invention, the cytidine deaminase or engineered adenosine deaminase with cytidine deaminase activity is capable of targeting Cytosine in a DNA single strand. In certain example embodiments the cytidine deaminase activity may edit on a single strand present outside of the binding component e.g. bound CRISPR-Cas. In other example embodiments, the cytidine deaminase may edit at a localized bubble, such as a localized bubble formed by a mismatch at the target edit site but the guide sequence. In certain example embodiments the cytidine deaminase may contain mutations that help focus the area of activity such as those disclosed in Kim et al., Nature Biotechnology (2017) 35(4):371-377 (doi:10.1038/nbt.3803.

In some embodiments, the cytidine deaminase is derived from one or more metazoa species, including but not limited to, mammals, birds, frogs, squids, fish, flies and worms. In some embodiments, the cytidine deaminase is a human, primate, cow, dog rat or mouse cytidine deaminase.

In some embodiments, the cytidine deaminase is a human APOBEC, including hAPOBEC1 or hAPOBEC3. In some embodiments, the cytidine deaminase is a human AID.

In some embodiments, the cytidine deaminase protein recognizes and converts one or more target cytosine residue(s) in a single-stranded bubble of a RNA duplex into uracil residues (s). In some embodiments, the cytidine deaminase protein recognizes a binding window on the single-stranded bubble of a RNA duplex. In some embodiments, the binding window contains at least one target cytosine residue(s). In some embodiments, the binding window is in the range of about 3 bp to about 100 bp. In some embodiments, the binding window is in the range of about 5 bp to about 50 bp. In some embodiments, the binding window is in the range of about 10 bp to about 30 bp. In some embodiments, the binding window is about 1 bp, 2 bp, 3 bp, 5 bp, 7 bp, 10 bp, 15 bp, 20 bp, 25 bp, 30 bp, 40 bp, 45 bp, 50 bp, 55 bp, 60 bp, 65 bp, 70 bp, 75 bp, 80 bp, 85 bp, 90 bp, 95 bp, or 100 bp.

In some embodiments, the cytidine deaminase protein comprises one or more deaminase domains. Not intended to be bound by theory, it is contemplated that the deaminase domain functions to recognize and convert one or more target cytosine (C) residue(s) contained in a single-stranded bubble of a RNA duplex into (an) uracil (U) residue (s). In some embodiments, the deaminase domain comprises an active center. In some embodiments, the active center comprises a zinc ion. In some embodiments, amino acid residues in or near the active center interact with one or more nucleotide(s) 5' to a target cytosine residue. In some embodiments, amino acid residues in or near the active center interact with one or more nucleotide(s) 3' to a target cytosine residue.

In some embodiments, the cytidine deaminase comprises human APOBEC1 full protein (hAPOBEC1) or the deaminase domain thereof (hAPOBEC1-D) or a C-terminally truncated version thereof (hAPOBEC-T). In some embodiments, the cytidine deaminase is an APOBEC family member that is homologous to hAPOBEC1, hAPOBEC-D or hAPOBEC-T. In some embodiments, the cytidine deaminase comprises human AID1 full protein (hAID) or the deaminase domain thereof (hAID-D) or a C-terminally truncated version thereof (hAID-T). In some embodiments, the cytidine deaminase is an AID family member that is homologous to hAID, hAID-D or hAID-T. In some embodiments, the hAID-T is a hAID which is C-terminally truncated by about 20 amino acids.

In some embodiments, the cytidine deaminase comprises the wild-type amino acid sequence of a cytosine deaminase. In some embodiments, the cytidine deaminase comprises one or more mutations in the cytosine deaminase sequence, such that the editing efficiency, and/or substrate editing preference of the cytosine deaminase is changed according to specific needs.

Certain mutations of APOBEC1 and APOBEC3 proteins have been described in Kim et al., Nature Biotechnology (2017) 35(4):371-377 (doi:10.1038/nbt.3803); and Harris et al. Mol. Cell (2002) 10:1247-1253, each of which is incorporated herein by reference in its entirety.

In some embodiments, the cytidine deaminase is an APOBEC1 deaminase comprising one or more mutations at amino acid positions corresponding to W90, R118, H121, H122, R126, or R132 in rat APOBEC1, or an APOBEC3G deaminase comprising one or more mutations at amino acid positions corresponding to W285, R313, D316, D317X, R320, or R326 in human APOBEC3G.

In some embodiments, the cytidine deaminase comprises a mutation at tryptophane90 of the rat APOBEC1 amino acid sequence, or a corresponding position in a homologous APOBEC protein, such as tryptophane285 of APOBEC3G. In some embodiments, the tryptophan residue at position 90 is replaced by an tyrosine or phenylalanine residue (W90Y or W90F).

In some embodiments, the cytidine deaminase comprises a mutation at Arginine118 of the rat APOBEC1 amino acid sequence, or a corresponding position in a homologous APOBEC protein. In some embodiments, the arginine residue at position 118 is replaced by an alanine residue (R118A).

In some embodiments, the cytidine deaminase comprises a mutation at Histidine121 of the rat APOBEC1 amino acid sequence, or a corresponding position in a homologous APOBEC protein. In some embodiments, the histidine residue at position 121 is replaced by an arginine residue (H121R).

In some embodiments, the cytidine deaminase comprises a mutation at Histidine122 of the rat APOBEC1 amino acid sequence, or a corresponding position in a homologous APOBEC protein. In some embodiments, the histidine residue at position 122 is replaced by an arginine residue (H122R).

In some embodiments, the cytidine deaminase comprises a mutation at Arginine126 of the rat APOBEC1 amino acid sequence, or a corresponding position in a homologous APOBEC protein, such as Arginine320 of APOBEC3G. In some embodiments, the arginine residue at position 126 is replaced by an alanine residue (R126A) or by a glutamic acid (R126E).

In some embodiments, the cytidine deaminase comprises a mutation at arginine132 of the APOBEC1 amino acid sequence, or a corresponding position in a homologous APOBEC protein. In some embodiments, the arginine residue at position 132 is replaced by a glutamic acid residue (R132E).

In some embodiments, to narrow the width of the editing window, the cytidine deaminase may comprise one or more of the mutations: W90Y, W90F, R126E and R132E, based on amino acid sequence positions of rat APOBEC1, and mutations in a homologous APOBEC protein corresponding to the above.

In some embodiments, to reduce editing efficiency, the cytidine deaminase may comprise one or more of the mutations: W90A, R118A, R132E, based on amino acid sequence positions of rat APOBEC1, and mutations in a homologous APOBEC protein corresponding to the above. In particular embodiments, it can be of interest to use a cytidine deaminase enzyme with reduced efficacy to reduce off-target effects.

In some embodiments, the cytidine deaminase is wild-type rat APOBEC1 (rAPOBEC1, or a catalytic domain thereof. In some embodiments, the cytidine deaminase comprises one or more mutations in the rAPOBEC1 sequence, such that the editing efficiency, and/or substrate editing reference of rAPOBEC1 is changed according to specific needs.

```
rAPOBEC1:
                                            (SEQ ID NO: 243)
MSSETGPVAVDPTLRRRIEPHEFEVFFDPRELRKETCLLYEINWGGRHSI

WRHTSQNTNKHVEVNFIEKFTTERYFCPNTRCSITWFLSWSPCGECSRAI

TEFLSRYPHVTLFIYIARLYHHADPRNRQGLRDLISSGVTIQIMTEQESG

YCWRNFVNYSPSNEAHWPRYPHLWVRLYVLELYCIILGLPPCLNILRRKQ

PQLTFFTIALQSCHYQRLPPHILWATGLK
```

In some embodiments, the cytidine deaminase is wild-type human APOBEC1 (hAPOBEC1) or a catalytic domain thereof. In some embodiments, the cytidine deaminase comprises one or more mutations in the hAPOBEC1 sequence, such that the editing efficiency, and/or substrate editing preference of hAPOBEC1 is changed according to specific needs.

```
APOBEC1:
                                            (SEQ ID NO: 244)
MTSEKGPSTGDPTLRRRIEPWEFDVFYDPRELRKEACLLYEIKWGMSRKI

WRSSGKNTTNHVEVNFIKKFTSERDFHPSMSCSITWFLSWSPCWECSQAI

REFLSRHPGVTLVIYVARLFWHMDQQNRQGLRDLVNSGVTIQIMRASEYY

HCWRNFVNYPPGDEAHWPQYPPLWMMLYALELHCIILSLPPCLKISRRWQ

NHLTFFRLHLQNCHYQTIPPHILLATGLIHPSVAWR
```

In some embodiments, the cytidine deaminase is wild-type human APOBEC3G (hAPOBEC3G) or a catalytic domain thereof. In some embodiments, the cytidine deaminase comprises one or more mutations in the hAPOBEC3G sequence, such that the editing efficiency, and/or substrate editing preference of hAPOBEC3G is changed according to specific needs.

hAPOBEC3G:
(SEQ ID NO: 245)
MELKYHPEMRFFHWFSKWRKLHRDQEYEVTWYISWSPCTKCTRDMATFLA
EDPKVTLTIFVARLYYFWDPDYQEALRSLCQKRDGPRATMKIMNYDEFQH
CWSKFVYSQRELEEPWNNLPKYYILLHIMLGEILRHSMDPPTFTENENNE
PWVRGRHETYLCYEVERMHNDTWVLLNQRRGELCNQAPHKHGELEGRHAE
LCFLDVIPFWKLDLDQDYRVTCFTSWSPCFSCAQEMAKFISKNKHVSLCI
FTARIYDDQGRCQEGLRTLAEAGAKISIMTYSEFKHCWDTFVDHQGCPFQ
PWDGLDEHSQDLSGRLRAILQNQEN

In some embodiments, the cytidine deaminase is wild-type *Petromyzon marinus* CDA1 (pmCDA1) or a catalytic domain thereof. In some embodiments, the cytidine deaminase comprises one or more mutations in the pmCDA1 sequence, such that the editing efficiency, and/or substrate editing preference of pmCDA1 is changed according to specific needs.

pmCDA1:
(SEQ ID NO: 246)
MTDAEYVRIHEKLDIYTFKKQFFNNKKSVSHRCYVLFELKRRGERRACFW
GYAVNKPQSGTERGIHAEIFSIRKVEEYLRDNPGQFTINWYSSWSPCADC
AEKILEWYNQELRGNGHTLKIWACKLYYEKNARNQIGLWNLRDNGVGLNV
MVSEHYQCCRKIFIQSSHNQLNENRWLEKTLKRAEKRRSELSIMIQVKIL
HTTKSPAV

In some embodiments, the cytidine deaminase is wild-type human AID (hAID) or a catalytic domain thereof. In some embodiments, the cytidine deaminase comprises one or more mutations in the pmCDA1 sequence, such that the editing efficiency, and/or substrate editing preference of pmCDA1 is changed according to specific needs.

hAID:
(SEQ ID NO: 247)
MDSLLMNRRKFLYQFKNVRWAKGRRETYLCYVVKRRDSATSFSLDFGYLR
NKNGCHVELLFLRYISDWDLDPGRCYRVTWFTSWSPCYDCARHVADFLRG
NPYLSLRIFTARLYFCEDRKAEPEGLRRLHRAGVQIAIMTFKDYFYCWNT
FVENHERTFKAWEGLHENSVRLSRQLRRILLPLYEVDDLRDAFRTLGLLD

In some embodiments, the cytidine deaminase is truncated version of hAID (hAID-DC) or a catalytic domain thereof. In some embodiments, the cytidine deaminase comprises one or more mutations in the hAID-DC sequence, such that the editing efficiency, and/or substrate editing preference of hAID-DC is changed according to specific needs.

hAID-DC:
(SEQ ID NO: 248)
MDSLLMNRRKFLYQFKNVRWAKGRRETYLCYVVKRRDSATSFSLDFGYLR
NKNGCHVELLFLRYISDWDLDPGRCYRVTWFTSWSPCYDCARHVADFLRG

-continued

NPNLSLRIFTARLYFCEDRKAEPEGLRRLHRAGVQIAIMTFKDYFYCWNT
FVENHERTFKAWEGLHENSVRLSRQLRRILL

Additional embodiments of the cytidine deaminase are disclosed in WO WO2017/070632, titled "Nucleobase Editor and Uses Thereof," which is incorporated herein by reference in its entirety.

In some embodiments, the cytidine deaminase has an efficient deamination window that encloses the nucleotides susceptible to deamination editing. Accordingly, in some embodiments, the "editing window width" refers to the number of nucleotide positions at a given target site for which editing efficiency of the cytidine deaminase exceeds the half-maximal value for that target site. In some embodiments, the cytidine deaminase has an editing window width in the range of about 1 to about 6 nucleotides. In some embodiments, the editing window width of the cytidine deaminase is 1, 2, 3, 4, 5, or 6 nucleotides.

Not intended to be bound by theory, it is contemplated that in some embodiments, the length of the linker sequence affects the editing window width. In some embodiments, the editing window width increases (e.g., from about 3 to about 6 nucleotides) as the linker length extends (e.g., from about 3 to about 21 amino acids). In a non-limiting example, a 16-residue linker offers an efficient deamination window of about 5 nucleotides. In some embodiments, the length of the guide RNA affects the editing window width. In some embodiments, shortening the guide RNA leads to a narrowed efficient deamination window of the cytidine deaminase.

In some embodiments, mutations to the cytidine deaminase affect the editing window width. In some embodiments, the cytidine deaminase component of the CD-functionalized CRISPR system comprises one or more mutations that reduce the catalytic efficiency of the cytidine deaminase, such that the deaminase is prevented from deamination of multiple cytidines per DNA binding event. In some embodiments, tryptophan at residue 90 (W90) of APOBEC1 or a corresponding tryptophan residue in a homologous sequence is mutated. In some embodiments, the catalytically inactive CRISPR-Cas is fused to or linked to an APOBEC1 mutant that comprises a W90Y or W90F mutation. In some embodiments, tryptophan at residue 285 (W285) of APOBEC3G, or a corresponding tryptophan residue in a homologous sequence is mutated. In some embodiments, the catalytically inactive CRISPR-Cas is fused to or linked to an APOBEC3G mutant that comprises a W285Y or W285F mutation.

In some embodiments, the cytidine deaminase component of CD-functionalized CRISPR system comprises one or more mutations that reduce tolerance for non-optimal presentation of a cytidine to the deaminase active site. In some embodiments, the cytidine deaminase comprises one or more mutations that alter substrate binding activity of the deaminase active site. In some embodiments, the cytidine deaminase comprises one or more mutations that alter the conformation of DNA to be recognized and bound by the deaminase active site. In some embodiments, the cytidine deaminase comprises one or more mutations that alter the substrate accessibility to the deaminase active site. In some embodiments, arginine at residue 126 (R126) of APOBEC1 or a corresponding arginine residue in a homologous sequence is mutated. In some embodiments, the catalytically inactive CRISPR-Cas is fused to or linked to an APOBEC1 that comprises a R126A or R126E mutation. In some embodiments, tryptophan at residue 320 (R320) of APOBEC3G, or a corresponding arginine residue in a homologous sequence is mutated. In some embodiments, the catalytically inactive CRISPR-Cas is fused to or linked to an APOBEC3G mutant that comprises a R320A or R320E mutation. In some embodiments, arginine at residue 132 (R132) of APOBEC1 or a corresponding arginine residue in a homologous sequence is mutated. In some embodiments, the catalytically inactive CRISPR-Cas is fused to or linked to an APOBEC1 mutant that comprises a R132E mutation.

In some embodiments, the APOBEC1 domain of the CD-functionalized CRISPR system comprises one, two, or three mutations selected from W90Y, W90F, R126A, R126E, and R132E. In some embodiments, the APOBEC1 domain comprises double mutations of W90Y and R126E. In some embodiments, the APOBEC1 domain comprises double mutations of W90Y and R132E. In some embodiments, the APOBEC1 domain comprises double mutations of R126E and R132E. In some embodiments, the APOBEC1 domain comprises three mutations of W90Y, R126E and R132E.

In some embodiments, one or more mutations in the cytidine deaminase as disclosed herein reduce the editing window width to about 2 nucleotides. In some embodiments, one or more mutations in the cytidine deaminase as disclosed herein reduce the editing window width to about 1 nucleotide. In some embodiments, one or more mutations in the cytidine deaminase as disclosed herein reduce the editing window width while only minimally or modestly affecting the editing efficiency of the enzyme. In some embodiments, one or more mutations in the cytidine deaminase as disclosed herein reduce the editing window width without reducing the editing efficiency of the enzyme. In some embodiments, one or more mutations in the cytidine deaminase as disclosed herein enable discrimination of neighboring cytidine nucleotides, which would be otherwise edited with similar efficiency by the cytidine deaminase.

In some embodiments, the cytidine deaminase protein further comprises or is connected to one or more double-stranded RNA (dsRNA) binding motifs (dsRBMs) or domains (dsRBDs) for recognizing and binding to double-stranded nucleic acid substrates. In some embodiments, the interaction between the cytidine deaminase and the substrate is mediated by one or more additional protein factor(s), including a CRISPR/CAS protein factor. In some embodiments, the interaction between the cytidine deaminase and the substrate is further mediated by one or more nucleic acid component(s), including a guide RNA.

According to the present invention, the substrate of the cytidine deaminase is an DNA single strand bubble of a RNA duplex comprising a Cytosine of interest, made accessible to the cytidine deaminase upon binding of the guide molecule to its DNA target which then forms the CRISPR-Cas complex with the CRISPR-Cas enzyme, whereby the cytosine deaminase is fused to or is capable of binding to one or more components of the CRISPR-Cas complex, i.e. the CRISPR-Cas enzyme and/or the guide molecule. The particular features of the guide molecule and CRISPR-Cas enzyme are detailed below.

The cytidine deaminase or catalytic domain thereof may be a human, a rat, or a lamprey cytidine deaminase protein or catalytic domain thereof.

The cytidine deaminase protein or catalytic domain thereof may be an apolipoprotein B mRNA-editing complex (APOBEC) family deaminase. The cytidine deaminase protein or catalytic domain thereof may be an activation-induced deaminase (AID). The cytidine deaminase protein or catalytic domain thereof may be a cytidine deaminase 1 (CDA1).

The cytidine deaminase protein or catalytic domain thereof may be an APOBEC1 deaminase. The APOBEC1 deaminase may comprise one or more mutations corresponding to W90A, W90Y, R118A, H121R, H122R, R126A, R126E, or R132E in rat APOBEC1, or an APOBEC3G deaminase comprising one or more mutations corresponding to W285A, W285Y, R313A, D316R, D317R, R320A, R320E, or R326E in human APOBEC3G.

The system may further comprise a uracil glycosylase inhibitor (UGI). Inn some embodiments, the cytidine deaminase protein or catalytic domain thereof is delivered together with a uracil glycosylase inhibitor (UGI). The GI may be linked (e.g., covalently linked) to the cytidine deaminase protein or catalytic domain thereof and/or a catalytically inactive CRISPR-Cas protein.

Regulation of Post-Translational Modification of Gene Products

In some cases, base editing may be used for regulating post-translational modification of a gene products. In some cases, an amino acid residue that is a post-translational modification site may be mutated by base editing to an amino residue that cannot be modified. Examples of such post-translational modifications include disulfide bond formation, glycosylation, lipidation, acetylation, phosphorylation, methylation, ubiquitination, sumoylation, or any combinations thereof.

In some embodiments, the base editors herein may regulate Stat3/IRF-5 pathway, e.g., for reduction of inflammation. For example, phosphorylation on Tyr705 of Stat3, Thr10, Ser158, Ser309, Ser317, Ser451, and/or Ser462 of IRF-5 may be involved with interleukin signaling. Base editors herein may be used to mutate one or more of these procreation sites for regulating immunity, autoimmunity, and/or inflammation.

In some embodiments, the base editors herein may regulate insulin receptor substrate (IRS) pathway. For example, phosphorylation on Ser265, Ser302, Ser325, Ser336, Ser358, Ser407, and/or Ser408 may be involved in regulating (e.g., inhibit) ISR pathway. Alternatively or additionally, Serine 307 in mouse (or Serine 312 in human) may be mutated so the phosphorylation may be regulated. For example, Serine 307 phosphorylation may lead to degradation of IRS-1 and reduce MAPK signaling. Serine 307 phosphorylation may be induced under insulin insensitivity conditions, such as insulin overstimulation and/or TNFα treatment. In some examples, S307F mutation may be generated for stabilizing the interaction between IRS-1 and other components in the pathway. Base editors herein may be used to mutate one or more of these procreation sites for regulating IRS pathway.

Regulation of Stability of Gene Products

In some embodiments, base editing may be used for regulating the stability of gene products. For example, one or more amino acid residues that regulate protein degradation rates may be mutated by the base editors herein. In some cases, such amino acid residues may be in a degron. A degron may refer to a portion of a protein involved in regulating the degradation rate of the protein. Degrons may include short amino acid sequences, structural motifs, and exposed amino acids (e.g., lysine or arginine). Some protein may comprise multiple degrons. The degrons be ubiquitin-dependent (e.g., regulating protein degradation based on ubiquitination of the protein) or ubiquitin-independent.

In some cases, the based editing may be used to mutate one or more amino acid residues in a signal peptide for protein degradation. In some examples, the signal peptide may be a PEST sequence, which is a peptide sequence that is rich in proline (P), glutamic acid (E), serine (S), and threonine (T). For example, the stability of NANOG, which comprises a PEST sequence, may be increased, e.g., to promote embryonic stem cell pluripotency.

In some examples, the base editors may be used for mutating SMN2 (e.g., to generate S270A mutilation) to increase stability of the SMN2 protein, which is involved in spinal muscular atrophy. Other mutations in SMN2 that may be generated by based editors include those described in Cho S. et al., Genes Dev. 2010 Mar. 1; 24(5): 438-442. In certain examples, the base editors may be used for generating mutations on IκBα, as described in Fortmann K T et al., J Mol Biol. 2015 Aug. 28; 427(17): 2748-2756. Target sites in degrons may be identified by computational tools, e.g., the online tools provided on slim.ucd.ie/apc/index.php. Other targets include Cdc25A phosphatase.

Examples of Genes that can be Targeted by Base Editors

In some examples, the base editors may be used for modifying PCSK9. The base editors may introduce stop codons and/or disease-associated mutations that reduce PCSK9 activity. The base editing may introduce one or more of the following mutations in PCSK9: R46L, R46A, A53V, A53A, E57K, Y142X, L253F, R237W, H391N, N425S, A443T, I474V, I474A, Q554E, Q619P, E670G, E670A, C679X, H417Q, R469W, E482G, F515L, and/or H553R.

In some examples, the base editors may be used for modifying ApoE. The base editors may target ApoE in synthetic model and/or patient-derived neurons (e.g., those derived from iPSC). The targeting may be tested by sequencing.

In some examples, the base editors may be used for modifying Stat1/3. The base editor may target Y705 and/or S727 for reducing Stat1/3 activation. The base editing may be tested by luciferase-based promoter. Targeting Stat1/3 by base editing may block monocyte to macrophage differentiation, and inflammation in response to ox-LDL stimulation of macrophages.

In some examples, the base editors may be used for modifying TFEB (transcription factor for EB). The base editor may target one or more amino acid residues that regulate translocation of the TFEB. In some cases, the base editor may target one or more amino acid residues that regulate autophagy.

In some examples, the base editors may be used for modifying ornithine carbamoyl transferase (OTC). Such modification may be used for correct ornithine carbamoyl transferase deficiency. For example, base editing may correct Leu45Pro mutation by converting nucleotide 134C to U. An example approach is shown in FIG. 102.

In some examples, the base editors may be used for modifying Lipin1. The base editor may target one or more serine's that can be phosphorylated by mTOR. Base editing of Lipin1 may regulate lipid accumulation. The base editors may target Lipin1 in 3T3L1 preadipocyte model. Effects of the base editing may be tested by measuring reduction of lipid accumulation (e.g., via oil red).

Base Editing Guide Molecule Design Considerations

In some embodiments, the guide sequence is an RNA sequence of between 10 to 50 nt in length, but more particularly of about 20-30 nt advantageously about 20 nt, 23-25 nt or 24 nt. In base editing embodiments, the guide sequence is selected so as to ensure that it hybridizes to the target sequence comprising the adenosine to be deaminated. This is described more in detail below. Selection can encompass further steps which increase efficacy and specificity of deamination.

In some embodiments, the guide sequence is about 20 nt to about 30 nt long and hybridizes to the target DNA strand to form an almost perfectly matched duplex, except for having a dA-C mismatch at the target adenosine site. Particularly, in some embodiments, the dA-C mismatch is located close to the center of the target sequence (and thus the center of the duplex upon hybridization of the guide sequence to the target sequence), thereby restricting the adenosine deaminase to a narrow editing window (e.g., about 4 bp wide). In some embodiments, the target sequence may comprise more than one target adenosine to be deaminated. In further embodiments the target sequence may further comprise one or more dA-C mismatch 3' to the target adenosine site. In some embodiments, to avoid off-target editing at an unintended Adenine site in the target sequence, the guide sequence can be designed to comprise a non-pairing Guanine at a position corresponding to said unintended Adenine to introduce a dA-G mismatch, which is catalytically unfavorable for certain adenosine deaminases such as ADAR1 and ADAR2. See Wong et al., RNA 7:846-858 (2001), which is incorporated herein by reference in its entirety.

In some embodiments, a CRISPR-Cas guide sequence having a canonical length (e.g., about 20 nt) is used to form a heteroduplex with the target DNA. In some embodiments, a CRISPR-Cas guide molecule longer than the canonical length (e.g., >20 nt) is used to form a heteroduplex with the target DNA including outside of the CRISPR-Cas-guide RNA-target DNA complex. This can be of interest where deamination of more than one adenine within a given stretch of nucleotides is of interest. In alternative embodiments, it is of interest to maintain the limitation of the canonical guide sequence length. In some embodiments, the guide sequence is designed to introduce a dA-C mismatch outside of the canonical length of CRISPR-Cas guide, which may decrease steric hindrance by CRISPR-Cas and increase the frequency of contact between the adenosine deaminase and the dA-C mismatch.

In some base editing embodiments, the position of the mismatched nucleobase (e.g., cytidine) is calculated from where the PAM would be on a DNA target. In some embodiments, the mismatched nucleobase is positioned 12-21 nt from the PAM, or 13-21 nt from the PAM, or 14-21 nt from the PAM, or 14-20 nt from the PAM, or 15-20 nt from the PAM, or 16-20 nt from the PAM, or 14-19 nt from the PAM, or 15-19 nt from the PAM, or 16-19 nt from the PAM, or 17-19 nt from the PAM, or about 20 nt from the PAM, or about 19 nt from the PAM, or about 18 nt from the PAM, or about 17 nt from the PAM, or about 16 nt from the PAM, or about 15 nt from the PAM, or about 14 nt from the PAM. In a preferred embodiment, the mismatched nucleobase is positioned 17-19 nt or 18 nt from the PAM.

Mismatch distance is the number of bases between the 3' end of the CRISPR-Cas spacer and the mismatched nucleobase (e.g., cytidine), wherein the mismatched base is included as part of the mismatch distance calculation. In some embodiment, the mismatch distance is 1-10 nt, or 1-9 nt, or 1-8 nt, or 2-8 nt, or 2-7 nt, or 2-6 nt, or 3-8 nt, or 3-7 nt, or 3-6 nt, or 3-5 nt, or about 2 nt, or about 3 nt, or about 4 nt, or about 5 nt, or about 6 nt, or about 7 nt, or about 8 nt. In a preferred embodiment, the mismatch distance is 3-5 nt or 4 nt.

In some embodiment, the editing window of a CRISPR-Cas-ADAR system described herein is 12-21 nt from the PAM, or 13-21 nt from the PAM, or 14-21 nt from the PAM, or 14-20 nt from the PAM, or 15-20 nt from the PAM, or 16-20 nt from the PAM, or 14-19 nt from the PAM, or 15-19 nt from the PAM, or 16-19 nt from the PAM, or 17-19 nt from the PAM, or about 20 nt from the PAM, or about 19 nt from the PAM, or about 18 nt from the PAM, or about 17 nt from the PAM, or about 16 nt from the PAM, or about 15 nt from the PAM, or about 14 nt from the PAM. In some embodiment, the editing window of the CRISPR-Cas-ADAR system described herein is 1-10 nt from the 3' end of the CRISPR-Cas spacer, or 1-9 nt from the 3' end of the CRISPR-Cas spacer, or 1-8 nt from the 3' end of the CRISPR-Cas spacer, or 2-8 nt from the 3' end of the CRISPR-Cas spacer, or 2-7 nt from the 3' end of the CRISPR-Cas spacer, or 2-6 nt from the 3' end of the CRISPR-Cas spacer, or 3-8 nt from the 3' end of the CRISPR-Cas spacer, or 3-7 nt from the 3' end of the CRISPR-Cas spacer, or 3-6 nt from the 3' end of the CRISPR-Cas spacer, or 3-5 nt from the 3' end of the CRISPR-Cas spacer, or about 2 nt from the 3' end of the CRISPR-Cas spacer, or about 3 nt from the 3' end of the CRISPR-Cas spacer, or about 4 nt from the 3' end of the CRISPR-Cas spacer, or about 5 nt from the 3' end of the CRISPR-Cas spacer, or about 6 nt from the 3' end of the CRISPR-Cas spacer, or about 7 nt from the 3' end of the CRISPR-Cas spacer, or about 8 nt from the 3' end of the CRISPR-Cas spacer.

Linkers

The deaminase herein may be fused to a Cas protein via a linker. It is further envisaged that RNA adenosine methylase (N(6)-methyladenosine) can be fused to the RNA targeting effector proteins of the invention and targeted to a transcript of interest. This methylase causes reversible methylation, has regulatory roles and may affect gene expression and cell fate decisions by modulating multiple RNA-related cellular pathways (Fu et al Nat Rev Genet. 2014; 15(5):293-306).

ADAR or other RNA modification enzymes may be linked (e.g., fused) to CRISPR-Cas or a dead CRISPR-Cas protein via a linker, e.g., to the C terminus or the N-terminus of CRISPR-Cas or dead CRISPR-Cas.

The term “linker” as used in reference to a fusion protein refers to a molecule which joins the proteins to form a fusion protein. Generally, such molecules have no specific biological activity other than to join or to preserve some minimum distance or other spatial relationship between the proteins. However, in certain embodiments, the linker may be selected to influence some property of the linker and/or the fusion protein such as the folding, net charge, or hydrophobicity of the linker.

Suitable linkers for use in the methods of the present invention are well known to those of skill in the art and include, but are not limited to, straight or branched-chain carbon linkers, heterocyclic carbon linkers, or peptide linkers. However, as used herein the linker may also be a covalent bond (carbon-carbon bond or carbon-heteroatom bond). In particular embodiments, the linker is used to separate the CRISPR-Cas protein and the nucleotide deaminase by a distance sufficient to ensure that each protein retains its required functional property. Preferred peptide linker sequences adopt a flexible extended conformation and do not exhibit a propensity for developing an ordered secondary structure. In certain embodiments, the linker can be a chemical moiety which can be monomeric, dimeric, multimeric or polymeric. Preferably, the linker comprises amino acids. Typical amino acids in flexible linkers include Gly, Asn and Ser. Accordingly, in particular embodiments, the linker comprises a combination of one or more of Gly, Asn and Ser amino acids. Other near neutral amino acids, such as Thr and Ala, also may be used in the linker sequence. Exemplary linkers are disclosed in Maratea et al. (1985), Gene 40: 39-46; Murphy et al. (1986) Proc. Nat'l. Acad. Sci. USA 83: 8258-62; U.S. Pat. Nos. 4,935,233; and 4,751,180. For example, GlySer linkers GGS, GGGS or GSG can be used. GGS, GSG, GGGS or GGGGS linkers can be used in repeats of 3 (such as $(GGS)_3$ (SEQ ID No. 249), $(GGGGS)_3$ (SEQ ID NO:79)) or 5, 6, 7, 9 or even 12 (SEQ ID NO:250-254) or more, to provide suitable lengths. In some cases, the linker may be $(GGGGS)_{3-15}$, For example, in some cases, the linker may be $(GGGGS)_{311}$, e.g., GGGGS (SEQ ID NO:255), $(GGGGS)_2$ (SEQ ID NO:256), $(GGGGS)_3$ (SEQ ID NO:79), $(GGGGS)_4$ (SEQ ID NO:257), $(GGGGS)_5$, $(GGGGS)_6$ (SEQ ID NO:251), $(GGGGS)_7$ (SEQ ID NO:252), $(GGGGS)_8$ (SEQ ID NO:258), $(GGGGS)_9$ (SEQ ID NO:253), $(GGGGS)_{10}$ (SEQ ID NO:259), or $(GGGGS)_{11}$ (SEQ ID NO:260).

In particular embodiments, linkers such as $(GGGGS)_3$ are preferably used herein. $(GGGGS)_6$ $(GGGGS)_9$ or $(GGGGS)_{12}$ may preferably be used as alternatives. Other preferred alternatives are $(GGGGS)_1$ (SEQ ID No 255), $(GGGGS)_2$ (SEQ ID No. 256), $(GGGGS)_4$, $(GGGGS)_5$, $(GGGGS)_7$, $(GGGGS)_8$, $(GGGGS)_{10}$, or $(GGGGS)_{11}$. In yet a further embodiment, LEPGEKPYKCPECGKSFSQSGALTRHQRTHTR (SEQ ID No:261) is used as a linker. In yet an additional embodiment, the linker is an XTEN linker. In particular embodiments, the CRISPR-cas protein is a CRISPR-Cas protein and is linked to the deaminase protein or its catalytic domain by means of an LEPGEKPYKCPECGKSFSQSGALTRHQRTHTR (SEQ ID No:261) linker. In further particular embodiments, the CRISPR-Cas protein is linked C-terminally to the N-terminus of a deaminase protein or its catalytic domain by means of an LEPGEKPYKCPECGKSFSQSGALTRHQRTHTR (SEQ ID No:261) linker. In addition, N- and C-terminal NLSs can also function as linker (e.g., PKKKRKVEASSPKKRKVEAS (SEQ ID No. 262)).

Examples of linkers are shown in the Table 8 below.

TABLE 8

| | |
|---|---|
| GGS | GGTGGTAGT (SEQ ID NO: 263) |
| GGSx3 (9) | GGTGGTAGTGGAGGGAGCGGCGGTTCA (SEQ ID NO: 264) |
| GGSx7 (21) | ggtggaggaggctctggtggaggcggtagcggaggcggagggtcgGGTGGTAGTGGAGGGAGCGGCGGTTCA (SEQ ID NO: 265) |
| XTEN | TCGGGATCTGAGACGCCTGGGACCTCGGAATCGGCTACGCCCGAAAGT (SEQ ID NO: 266) |
| Z-EGFR_Short | Gtggataacaaatttaacaaagaaatgtgggcggcgtgggaagaaattcgtaacctgccgaacctgaacggctggcagatgaccgcgtttattgcgagcctggtggatgatccgagccagagcgcgaacctgctggcggaagcgaaaaaactgaacgatgcgcaggcgccgaaaaccggcggtggttctggt (SEQ ID NO: 267) |
| GSAT | Ggtggttctgccggtggctccggttctggctccagcggtggcagctctggtgcgtccggcacgggtactgcgggtggcactggcagcggttccggtactggctctggc (SEQ ID NO: 268) |

A nucleotide deaminase or other RNA modification enzyme may be linked to CRISPR-Cas or a dead CRISPR-Cas via one or more amino acids. In some cases, the nucleotide deaminase may be linked to the CRISPR-Cas or a dead CRISPR-Cas via one or more amino acids 411-429, 114-124, 197-241, and 607-624. The amino acid position may correspond to a CRISPR-Cas ortholog disclosed herein. In certain examples, the nucleotide deaminase may be is linked to the dead CRISPR-Cas via one or more amino acids corresponding to amino 411-429, 114-124, 197-241, and 607-624 of *Prevotella buccae* CRISPR-Cas.

Methods of Use in General

In another aspect, the present disclosure discloses methods of using the compositions and systems herein. In general, the methods include modifying a target nucleic acid by introducing in a cell or organism that comprises the target nucleic acid the engineered CRISPR-Cas protein, polynucleotide(s) encoding engineered CRISPR-Cas protein, the CRISPR-Cas system, or the vector or vector system comprising the polynucleotide(s), such that the engineered CRISPR-Cas protein modifies the target nucleic acid in the cell or organism. The engineered CRISPR-Cas protein or system may be introduced via delivery by liposomes, nanoparticles, exosomes, microvesicles, nucleic acid nanoassemblies, a gene gun, an implantable device, or the vector system herein. The cell or organisms may be a eukaryotic cell or organism. The cell or organisms is an animal cell or organism. The cell or organisms is a plant cell or organism. Examples of nucleic acid nanoassemblies include DNA origami and RNA origami, e.g., those described in U.S. Pat. No. 8,554,489, US20160103951, WO2017189914, and WO2017189870, which are incorporated by reference in their entireties. A gene gun may include a biolistic particle delivery system, which is a device for delivering exogenous DNA (transgenes) to cells. The payload may be an elemental particle of a heavy metal coated with DNA (typically plasmid DNA). An example of delivery components in CRISPR-Cas systems is described in Svitashev et al., Nat Commun. 2016; 7: 13274.

In some embodiments, the target nucleic acid comprises a genomic locus, and the engineered CRISPR-Cas protein modifies gene product encoded at the genomic locus or expression of the gene product. The target nucleic acid is DNA or RNA and wherein one or more nucleotides in the target nucleic acid may be base edited. The target nucleic acid may be DNA or RNA and wherein the target nucleic acid is cleaved. The engineered CRISPR-Cas protein may further cleave non-target nucleic acid.

In some embodiments, the methods may further comprise visualizing activity and, optionally, using a detectable label. The method may also comprise detecting binding of one or more components of the CRISPR-Cas system to the target nucleic acid.

In another aspect the methods of use include detecting a target nucleic acid in a sample. In some embodiments, the methods include contacting a sample with: an engineered CRISPR-Cas protein herein; at least one guide polynucleotide comprising a guide sequence capable of binding to the target nucleic acid and designed to form a complex with the engineered CRISPR-Cas; and a RNA-based masking construct comprising a non-target sequence; wherein the engineered CRISPR-Cas protein exhibits collateral RNase activity and cleaves the non-target sequence of the detection construct; and detecting a signal from cleavage of the non-target sequence, thereby detecting the target nucleic acid in the sample. The methods may further comprise contacting the sample with reagents for amplifying the target nucleic acid. The reagents for amplifying may comprise isothermal amplification reaction reagents. The isothermal amplification reagents may comprise nucleic-acid sequence-based amplification, recombinase polymerase amplification, loop-mediated isothermal amplification, strand displacement amplification, helicase-dependent amplification, or nicking enzyme amplification reagents. The target nucleic acid is DNA molecule and the method may further comprise contacting the target DNA molecule with a primer comprising an RNA polymerase site and RNA polymerase.

The masking construct: suppresses generation of a detectable positive signal until the masking construct cleaved or deactivated, or masks a detectable positive signal or generates a detectable negative signal until the masking construct cleaved or deactivated. The masking construct may comprise: a silencing RNA that suppresses generation of a gene product encoded by a reporting construct, wherein the gene product generates the detectable positive signal when expressed; a ribozyme that generates the negative detectable signal, and wherein the positive detectable signal is generated when the ribozyme is deactivated; or a ribozyme that converts a substrate to a first color and wherein the substrate converts to a second color when the ribozyme is deactivated; an aptamer and/or comprises a polynucleotide-tethered inhibitor; a polynucleotide to which a detectable ligand and a masking component are attached; a nanoparticle held in aggregate by bridge molecules, wherein at least a portion of the bridge molecules comprises a polynucleotide, and wherein the solution undergoes a color shift when the nanoparticle is disbursed in solution; a quantum dot or fluorophore linked to one or more quencher molecules by a linking molecule, wherein at least a portion of the linking molecule comprises a polynucleotide; a polynucleotide in complex with an intercalating agent, wherein the intercalating agent changes absorbance upon cleavage of the polynucleotide; or two fluorophores tethered by a polynucleotide that undergo a shift in fluorescence when released from the polynucleotide.

The aptamer may comprise a polynucleotide-tethered inhibitor that sequesters an enzyme, wherein the enzyme generates a detectable signal upon release from the aptamer or polynucleotide-tethered inhibitor by acting upon a substrate; or may be an inhibitory aptamer that inhibits an enzyme and prevents the enzyme from catalyzing generation of a detectable signal from a substrate or wherein the polynucleotide-tethered inhibitor inhibits an enzyme and prevents the enzyme from catalyzing generation of a detectable signal from a substrate; or sequesters a pair of agents that when released from the aptamers combine to generate a detectable signal.

The nanoparticle may be a colloidal metal. The colloidal metal material may include water-insoluble metal particles or metallic compounds dispersed in a liquid, a hydrosol, or a metal sol. The colloidal metal may be selected from the metals in groups IA, IB, IIB and IIIB of the periodic table, as well as the transition metals, especially those of group VIII. Preferred metals include gold, silver, aluminum, ruthenium, zinc, iron, nickel and calcium. Other suitable metals also include the following in all of their various oxidation states: lithium, sodium, magnesium, potassium, scandium, titanium, vanadium, chromium, manganese, cobalt, copper, gallium, strontium, niobium, molybdenum, palladium, indium, tin, tungsten, rhenium, platinum, and gadolinium. The metals are preferably provided in ionic form, derived from an appropriate metal compound, for example the $Al^{3+}$, $Ru^{3+}$, $Zn^{2+}$, $Fe^{3+}$, $Ni^{2+}$ and $Ca^{2+}$ ions.

When the RNA bridge is cut by the activated CRISPR effector, the beforementioned color shift is observed. In certain example embodiments the particles are colloidal metals. In certain other example embodiments, the colloidal metal is a colloidal gold. In certain example embodiments, the colloidal nanoparticles are 15 nm gold nanoparticles (AuNPs). Due to the unique surface properties of colloidal gold nanoparticles, maximal absorbance is observed at 520 nm when fully dispersed in solution and appear red in color to the naked eye. Upon aggregation of AuNPs, they exhibit a red-shift in maximal absorbance and appear darker in color, eventually precipitating from solution as a dark purple aggregate.

In some embodiments, at least one guide polynucleotide comprises a mismatch. The mismatch may be up- or downstream of a single nucleotide variation on the one or more guide sequences. In certain embodiments, modulations of cleavage efficiency can be exploited by introduction of mismatches, e.g. 1 or more mismatches, such as 1 or 2 mismatches between spacer sequence and target sequence, including the position of the mismatch along the spacer/target. The more central (i.e. not 3' or 5') for instance a double mismatch is, the more cleavage efficiency is affected. Accordingly, by choosing mismatch position along the spacer, cleavage efficiency can be modulated. By means of example, if less than 100% cleavage of targets is desired (e.g. in a cell population), 1 or more, such as preferably 2 mismatches between spacer and target sequence may be introduced in the spacer sequences. The more central along the spacer of the mismatch position, the lower the cleavage percentage. In certain example embodiments, the cleavage efficiency may be exploited to design single guides that can distinguish two or more targets that vary by a single nucleotide, such as a single nucleotide polymorphism (SNP), variation, or (point) mutation. The CRISPR effector may have reduced sensitivity to SNPs (or other single nucleotide variations) and continue to cleave SNP targets with a certain level of efficiency. Thus, for two targets, or a set of targets, a guide RNA may be designed with a nucleotide sequence that is complementary to one of the targets i.e. the on-target SNP. The guide RNA is further designed to have a synthetic mismatch. As used herein a "synthetic mismatch" refers to a non-naturally occurring mismatch that is introduced upstream or downstream of the naturally occurring SNP, such as at most 5 nucleotides upstream or downstream, for instance 4, 3, 2, or 1 nucleotide upstream or downstream, preferably at most 3 nucleotides upstream or downstream, more preferably at most 2 nucleotides upstream or downstream, most preferably 1 nucleotide upstream or downstream (i.e. adjacent the SNP). When the CRISPR effector binds to the on-target SNP, only a single mismatch will be formed with the synthetic mismatch and the CRISPR effector will continue to be activated and a detectable signal produced. When the guide RNA hybridizes to an off-target SNP, two mismatches will be formed, the mismatch from the SNP and the synthetic mismatch, and no detectable signal generated. Thus, the systems disclosed herein may be designed to distinguish SNPs within a population. For, example the systems may be used to distinguish pathogenic strains that differ by a single SNP or detect certain disease specific SNPs, such as but not limited to, disease associated SNPs, such as without limitation cancer associated SNPs.

In certain embodiments, the guide RNA is designed such that the SNP is located on position 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 of the spacer sequence (starting at the 5' end). In certain embodiments, the guide RNA is designed such that the SNP is located on position 1, 2, 3, 4, 5, 6, 7, 8, or 9 of the spacer sequence (starting at the 5' end). In certain embodiments, the guide RNA is designed such that the SNP is located on position 2, 3, 4, 5, 6, or 7 of the spacer sequence (starting at the 5' end). In certain embodiments, the guide RNA is designed such that the SNP is located on position 3, 4, 5, or 6 of the spacer sequence (starting at the 5' end). In certain embodiments, the guide RNA is designed such that the SNP is located on position 3 of the spacer sequence (starting at the 5' end).

In certain embodiments, the guide RNA is designed such that the mismatch (e.g. The synthetic mismatch, i.e. an additional mutation besides a SNP) is located on position 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 of the spacer sequence (starting at the 5' end). In certain embodiments, the guide RNA is designed such that the mismatch is located on position 1, 2, 3, 4, 5, 6, 7, 8, or 9 of the spacer sequence (starting at the 5' end). In certain embodiments, the guide RNA is designed such that the mismatch is located on position 4, 5, 6, or 7 of the spacer sequence (starting at the 5' end. In certain embodiments, the guide RNA is designed such that the mismatch is located on position 5 of the spacer sequence (starting at the 5' end).

In certain embodiments, the guide RNA is designed such that the mismatch is located 2 nucleotides upstream of the SNP (i.e. one intervening nucleotide). In certain embodiments, the guide RNA is designed such that the mismatch is located 2 nucleotides downstream of the SNP (i.e. one intervening nucleotide). In certain embodiments, the guide RNA is designed such that the mismatch is located on position 5 of the spacer sequence (starting at the 5' end) and the SNP is located on position 3 of the spacer sequence (starting at the 5' end).

Transcript Tracking

In another aspect, the present disclosure provides compositions and methods for transcript tracking. In some embodiments, transcript tracking allows researchers to visualize transcripts in cells, tissues, organs or animals, providing important spatio-temporal information regarding RNA dynamics and function. An example approach is shown in FIG. 102.

In some embodiments, the compositions may be a CRISPR-Cas protein herein with one or more labels, or a CRISPR-Cas system comprising such labeled CRISPR-Cas protein. The CRISPR-Cas protein or system may bind to one or more transcripts such that the transcripts may be detected (e.g., visualized) using the label on the CRISPR-Cas protein.

In some embodiments, the present disclosure includes a system for expressing a CRISPR-Cas protein with one or more polypeptides or polynucleotide labels. The system may comprise polynucleotides encoding the CRISPR-Cas protein and/or the labels. The system may further include vector systems comprising such polynucleotides. For example, a CRISPR-Cas protein may be fused with a fluorescent protein or a fragment thereof. Examples of fluorescent proteins include GFP proteins, EGFP, Azami-Green, Kaede, ZsGreen1 and CopGFP; CFP proteins, such as Cerulean, mCFP, AmCyan1, MiCy, and CyPet; BFP proteins such as EBFP; YFP proteins such as EYFP, YPet, Venus, ZsYellow, and mCitrine; OFP proteins such as cOFP, mKO, and mOrange; red fluorescent protein, or RFP; red or far-red fluorescent proteins from any other species, such as *Heteractis* reef coral and *Actinia* or *Entacmaea* sea anemone, as well as variants thereof. RFPs include, for example, *Discosoma* variants, such as mRFP1, mCherry, tdTomato, mStrawberry, mTangerine, DsRed2, and DsRed-T1, *Anthomedusa* J-Red and *Anemonia* AsRed2. Far-red fluorescent proteins include, for example, *Actinia* AQ143, *Entacmaea* eqFP611, *Discosoma* variants such as mPlum and mRasberry, and *Heteractis* HcRed1 and t-HcRed.

In some cases, the systems for expressing the labeled CRISPR-Cas protein may be inducible. For example, the systems may comprise polynucleotides encoding the CRISPR-Cas protein and/or labels under control of a regulatory element herein, e.g., inducible promoters. Such systems may allow spatial and/or temporal control of the expression of the labels, thus enabling spatial and/or temporal control of transcript tracking.

In certain cases, the CRISPR-Cas may be labeled with a detectable tag. The labeling may be performed in cells. Alternatively or additionally, the labeling may be performed first and the labeled CRISPR-Cas protein is then delivered into cells, tissues, organs, or organs.

The detectable tags may be detected (e.g., visualized by imaging, ultrasound, or MRI). Examples of such detectable tags include detectable oligonucleotide tags may be, but are not limited to, oligonucleotides comprising unique nucleotide sequences, oligonucleotides comprising detectable moieties, and oligonucleotides comprising both unique nucleotide sequences and detectable moieties. In some cases, the detectable tag comprises a labeling substance, which is detectable by spectroscopic, photochemical, biochemical, immunochemical, electrical, optical or chemical means. Such tags include biotin for staining with labeled streptavidin conjugate, magnetic beads (e.g., Dynabeads®), fluorescent dyes (e.g., fluorescein, texas red, rhodamine, green fluorescent protein, and the like), radiolabels (e.g., $^{3}H$, $^{125}I$, $^{35}S$, $^{14}C$, or $^{32}P$), enzymes (e.g., horse radish peroxidase, alkaline phosphatase and others commonly used in an ELISA), and calorimetric labels such as colloidal gold or colored glass or plastic (e.g., polystyrene, polypropylene, latex, etc.) beads. Detectable tags may be detected by many methods. For example, radiolabels may be detected using photographic film or scintillation counters, fluorescent markers may be detected using a photodetector to detect emitted light. Enzymatic labels are typically detected by providing the enzyme with a substrate and detecting, the reaction product produced by the action of the enzyme on the substrate, and calorimetric labels are detected by simply visualizing the colored label. Examples of the labeling substance which may be employed include labeling substances known to those skilled in the art, such as fluorescent dyes, enzymes, coenzymes, chemiluminescent substances, and radioactive substances. Specific examples include radioisotopes (e.g., $^{32}P$, $^{14}C$, $^{125}$, $^{3}H$, and $^{131}I$), fluorescein, rhodamine, dansyl chloride, umbelliferone, luciferase, peroxidase, alkaline phosphatase, β-galactosidase, β-glucosidase, horseradish peroxidase, glucoamylase, lysozyme, saccharide oxidase, microperoxidase, biotin, and ruthenium. In the case where biotin is employed as a labeling substance, preferably, after addition of a biotin-labeled antibody, streptavidin bound to an enzyme (e.g., peroxidase) is further added. Advantageously, the label is a fluorescent label. Examples of fluorescent labels include, but are not limited to, Atto dyes, 4-acetamido-4'-isothiocyanatostilbene-2,2'disulfonic acid; acridine and derivatives: acridine, acridine isothiocyanate; 5-(2'-aminoethyl)aminonaphthalene-1-sulfonic acid (EDANS); 4-amino-N-[3-vinylsulfonyl)phenyl]naphthalimide-3,5 disulfonate; N-(4-anilino-1-naphthyl)maleimide; anthranilamide; BODIPY; Brilliant Yellow; coumarin and derivatives; coumarin, 7-amino-4-methylcoumarin (AMC, Coumarin 120), 7-amino-4-trifluoromethylcouluarin (Coumaran 151); cyanine dyes; cyanosine; 4',6-diaminidino-2-phenylindole (DAPI); 5'5"-dibromopyrogallol-sulfonaphthalein (Bromopyrogallol Red); 7-diethylamino-3-(4'-isothiocyanatophenyl)-4-methylcoumarin; diethylenetriamine pentaacetate; 4,4'-diisothiocyanatodihydro-stilbene-2,2'-disulfonic acid; 4,4'-diisothiocyanatostilbene-2,2'-disulfonic acid; 5-[dimethylamino] naphthalene-1-sulfonyl chloride (DNS, dansylchloride); 4-dimethylaminophenylazophenyl-4'-isothiocyanate (DABITC); eosin and derivatives; eosin, eosin isothiocyanate, erythrosin and derivatives; erythrosin B, erythrosin, isothiocyanate; ethidium; fluorescein and derivatives; 5-carboxyfluorescein (FAM), 5-(4,6-dichlorotriazin-2-yl)aminofluorescein (DTAF), 2',7'-dimethoxy-4'5'-dichloro-6-carboxyfluorescein, fluorescein, fluorescein isothiocyanate, QFITC, (XRITC); fluorescamine; IR144; IR1446; Malachite Green isothiocyanate; 4-methylumbelliferoneortho cresolphthalein; nitrotyrosine; pararosaniline; Phenol Red; B-phycoerythrin; o-phthaldialdehyde; pyrene and derivatives: pyrene, pyrene butyrate, succinimidyl 1-pyrene; butyrate quantum dots; Reactive Red 4 (Cibacron™ Brilliant Red 3B-A) rhodamine and derivatives: 6-carboxy-X-rhodamine (ROX), 6-carboxyrhodamine (R6G), lissamine rhodamine B sulfonyl chloride rhodamine (Rhod), rhodamine B, rhodamine 123, rhodamine X isothiocyanate, sulforhodamine B, sulforhodamine 101, sulfonyl chloride derivative of sulforhodamine 101 (Texas Red); N,N,N',N' tetramethyl-6-carboxyrhodamine (TAMRA); tetramethyl rhodamine; tetramethyl rhodamine isothiocyanate (TRITC); riboflavin; rosolic acid; terbium chelate derivatives; Cy3; Cy5; Cy5.5; Cy7; TRD 700; IRD 800; La Jolta Blue; phthalo cyanine; and naphthalo cyanine. A fluorescent label may be a fluorescent protein, such as blue fluorescent protein, cyan fluorescent protein, green fluorescent protein, red fluorescent protein, yellow fluorescent protein or any photoconvertible protein. Colorimetric labeling, bioluminescent labeling and/or chemiluminescent labeling may further accomplish labeling. Labeling further may include energy transfer between molecules in the hybridization complex by perturbation analysis, quenching, or electron transport between donor and acceptor molecules, the latter of which may be facilitated by double stranded match hybridization complexes. The fluorescent label may be a perylene or a terrylen. In the alternative, the fluorescent label may be a fluorescent bar code. Advantageously, the label may be light sensitive, wherein the label is light-activated and/or light cleaves the one or more linkers to release the molecular cargo. The light-activated molecular cargo may be a major light-harvesting complex (LHCII). In another embodiment, the fluorescent label may induce free radical formation. In some embodiments, the detectable moieties may be quantum dots.

In some embodiments, the present disclosure provides for a system for delivery the labeled CRISPR-Cas proteins or labeled CRISPR-Cas systems. The delivery system may comprise any delivery vehicles, e.g., those described herein such as RNP, liposomes, nanoparticles, exosomes, microvesicles, nucleic acid nanoassemblies, a gene gun, an implantable device, or the vector systems herein.

Nucleic Acid Targeting

In certain embodiments, the CRISPR-Cas effector protein of the invention is, or in, or comprises, or consists essentially of, or consists of, or involves or relates to such a protein from or as set forth in Tables 1-4, wherein one or more amino acids are mutated, as described herein elsewhere. Thus, in some embodiments, the effector protein may be a RNA-binding protein, such as a dead-Cas type effector protein, which may be optionally functionalized as described herein for instance with an transcriptional activator or repressor domain, NLS or other functional domain. In some embodiments, the effector protein may be a RNA-binding protein that cleaves a single strand of RNA. If the RNA bound is ssRNA, then the ssRNA is fully cleaved. In some embodiments, the effector protein may be a RNA-binding protein that cleaves a double strand of RNA, for example if it comprises two RNase domains. If the RNA bound is dsRNA, then the dsRNA is fully cleaved. In some embodiments, the effector protein may be a RNA-binding protein that has nickase activity, i.e. it binds dsRNA, but only cleaves one of the RNA strands.

RNase function in CRISPR systems is known, for example mRNA targeting has been reported for certain type III CRISPR-Cas systems (Hale et al., 2014, Genes Dev, vol. 28, 2432-2443; Hale et al., 2009, Cell, vol. 139, 945-956; Peng et al., 2015, Nucleic acids research, vol. 43, 406-417) and provides significant advantages. A CRISPR-Cas system, composition or method targeting RNA via the present effector proteins is thus provided.

The target RNA, i.e. the RNA of interest, is the RNA to be targeted by the present invention leading to the recruitment to, and the binding of the effector protein at, the target site of interest on the target RNA. The target RNA may be any suitable form of RNA. This may include, in some embodiments, mRNA. In other embodiments, the target RNA may include tRNA or rRNA.

Self-Inactivating Systems

Once all copies of RNA in a cell have been edited, continued a CRISPR-Cas effector protein expression or activity in that cell is no longer necessary. A Self-Inactivating system that relies on the use of RNA as to the CRISPR-Cas or crRNA as the guide target sequence can shut down the system by preventing expression of CRISPR-Cas or complex formation.

Examples of Target RNAs

The compositions and systems herein may be used for editing various types of target RNAs. Examples of target RNAs are described below.

Interfering RNA (RNAi) and microRNA (miRNA)

In other embodiments, the target RNA may include interfering RNA, i.e. RNA involved in an RNA interference pathway, such as shRNA, siRNA and so forth. In other embodiments, the target RNA may include microRNA (miRNA). Control over interfering RNA or miRNA may help reduce off-target effects (OTE) seen with those approaches by reducing the longevity of the interfering RNA or miRNA in vivo or in vitro.

If the effector protein and suitable guide are selectively expressed (for example spatially or temporally under the control of a suitable promoter, for example a tissue- or cell cycle-specific promoter and/or enhancer) then this could be used to 'protect' the cells or systems (in vivo or in vitro) from RNAi in those cells. This may be useful in neighboring tissues or cells where RNAi is not required or for the purposes of comparison of the cells or tissues where the effector protein and suitable guide are and are not expressed (i.e. where the RNAi is not controlled and where it is, respectively). The effector protein may be used to control or bind to molecules comprising or consisting of RNA, such as ribozymes, ribosomes or riboswitches. In embodiments of the invention, the RNA guide can recruit the effector protein to these molecules so that the effector protein is able to bind to them.

Ribosomal RNA (rRNA)

For example, azalide antibiotics such as azithromycin, are well known. They target and disrupt the 50S ribosomal subunit. The present effector protein, together with a suitable guide RNA to target the 50S ribosomal subunit, may be, in some embodiments, recruited to and bind to the 50S ribosomal subunit. Thus, the present effector protein in concert with a suitable guide directed at a ribosomal (especially the 50s ribosomal subunit) target is provided. Use of this use effector protein in concert with the suitable guide directed at the ribosomal (especially the 50s ribosomal subunit) target may include antibiotic use. In particular, the antibiotic use is analogous to the action of azalide antibiotics, such as azithromycin. In some embodiments, prokaryotic ribosomal subunits, such as the 70S subunit in prokaryotes, the 50S subunit mentioned above, the 30S subunit, as well as the 16S and 5S subunits may be targeted. In other embodiments, eukaryotic ribosomal subunits, such as the 80S subunit in eukaryotes, the 60S subunit, the 40S subunit, as well as the 28S, 18S. 5.8S and 5S subunits may be targeted.

The effector protein may be a RNA-binding protein, optionally functionalized, as described herein. In some embodiments, the effector protein may be a RNA-binding protein that cleaves a single strand of RNA. In either case, but particularly where the RNA-binding protein cleaves a single strand of RNA, then ribosomal function may be modulated and, in particular, reduced or destroyed. This may apply to any ribosomal RNA and any ribosomal subunit and the sequences of rRNA are well known.

Control of ribosomal activity is thus envisaged through use of the present effector protein in concert with a suitable guide to the ribosomal target. This may be through cleavage of, or binding to, the ribosome. In particular, reduction of ribosomal activity is envisaged. This may be useful in assaying ribosomal function in vivo or in vitro, but also as a means of controlling therapies based on ribosomal activity, in vivo or in vitro. Furthermore, control (i.e. reduction) of protein synthesis in an in vivo or in vitro system is envisaged, such control including antibiotic and research and diagnostic use.

Riboswitches

A riboswitch (also known as an aptozyme) is a regulatory segment of a messenger RNA molecule that binds a small molecule. This typically results in a change in production of the proteins encoded by the mRNA. Thus, control of riboswitch activity is thus envisaged through use of the present effector protein in concert with a suitable guide to the riboswitch target. This may be through cleavage of, or binding to, the riboswitch. In particular, reduction of riboswitch activity is envisaged. This may be useful in assaying riboswitch function in vivo or in vitro, but also as a means of controlling therapies based on riboswitch activity, in vivo or in vitro. Furthermore, control (i.e. reduction) of protein synthesis in an in vivo or in vitro system is envisaged. This control, as for rRNA may include antibiotic and research and diagnostic use.

Ribozymes

Ribozymes are RNA molecules having catalytic properties, analogous to enzymes (which are of course proteins). As ribozymes, both naturally occurring and engineered, comprise or consist of RNA, they may also be targeted by the present RNA-binding effector protein. In some embodiments, the effector protein may be a RNA-binding protein cleaves the ribozyme to thereby disable it. Control of ribozymal activity is thus envisaged through use of the present effector protein in concert with a suitable guide to the ribozymal target. This may be through cleavage of, or binding to, the ribozyme. In particular, reduction of ribozymal activity is envisaged. This may be useful in assaying ribozymal function in vivo or in vitro, but also as a means of controlling therapies based on ribozymal activity, in vivo or in vitro.

RNA-Targeting Applications

Gene Expression, Including RNA Processing

The effector protein may also be used, together with a suitable guide, to target gene expression, including via control of RNA processing. The control of RNA processing may include RNA processing reactions such as RNA splicing, including alternative splicing, via targeting of RNApol; viral replication (in particular of satellite viruses, bacteriophages and retroviruses, such as HBV, HBC and HIV and others listed herein) including virioids in plants; and tRNA biosynthesis. The effector protein and suitable guide may also be used to control RNA activation (RNAa). RNAa leads to the promotion of gene expression, so control of gene expression may be achieved that way through disruption or reduction of RNAa and thus less promotion of gene expression.

RNAi Screens

Identifying gene products whose knockdown is associated with phenotypic changes, biological pathways can be interrogated and the constituent parts identified, via RNAi screens. Control may also be exerted over or during these screens by use of the effector protein and suitable guide to remove or reduce the activity of the RNAi in the screen and thus reinstate the activity of the (previously interfered with) gene product (by removing or reducing the interference/repression).

Satellite RNAs (satRNAs) and satellite viruses may also be treated.

Control herein with reference to RNase activity generally means reduction, negative disruption or known-down or knock out.

In Vivo RNA Applications

Inhibition of Gene Expression

The target-specific RNases provided herein allow for very specific cutting of a target RNA. The interference at RNA level allows for modulation both spatially and temporally and in a non-invasive way, as the genome is not modified.

A number of diseases have been demonstrated to be treatable by mRNA targeting. While most of these studies relate to administration of siRNA, it is clear that the RNA targeting effector proteins provided herein can be applied in a similar way.

Examples of mRNA targets (and corresponding disease treatments) are VEGF, VEGF-R1 and RTP801 (in the treatment of AMD and/or DME), Caspase 2 (in the treatment of Naion) ADRB2 (in the treatment of intraocular pressure), TRPVI (in the treatment of Dry eye syndrome, Syk kinase (in the treatment of asthma), Apo B (in the treatment of hypercholesterolemia), PLK1, KSP and VEGF (in the treatment of solid tumors), Ber-Abl (in the treatment of C-L) (Burnett and Rossi Chem Biol. 2012, 19(1): 60-71)). Similarly, RNA targeting has been demonstrated to be effective in the treatment of RNA-virus mediated diseases such as HIV (targeting of HIV Tet and Rev), RSV (targeting of RSV nucleocapsid) and HCV (targeting of miR-122) (Burnett and Rossi Chem Biol. 2012, 19(1): 60-71).

It is further envisaged that the RNA targeting effector protein of the invention can be used for mutation specific or allele specific knockdown. Guide RNA's can be designed that specifically target a sequence in the transcribed mRNA comprising a mutation or an allele-specific sequence. Such specific knockdown is particularly suitable for therapeutic applications relating to disorders associated with mutated or allele-specific gene products. For example, most cases of familial hypobetalipoproteinemia (FHBL) are caused by mutations in the ApoB gene. This gene encodes two versions of the apolipoprotein B protein: a short version (ApoB-48) and a longer version (ApoB-100). Several ApoB gene mutations that lead to FHBL cause both versions of ApoB to be abnormally short. Specifically targeting and knockdown of mutated ApoB mRNA transcripts with an RNA targeting effector protein of the invention may be beneficial in treatment of FHBL. As another example, Huntington's disease (HD) is caused by an expansion of CAG triplet repeats in the gene coding for the Huntingtin protein, which results in an abnormal protein. Specifically targeting and knockdown of mutated or allele-specific mRNA transcripts encoding the Huntingtin protein with an RNA targeting effector protein of the invention may be beneficial in treatment of HD.

Modulation of Gene Expression Through Modulation of RNA Function

Apart from a direct effect on gene expression through cleavage of the mRNA, RNA targeting can also be used to impact specific aspects of the RNA processing within the cell, which may allow a more subtle modulation of gene expression. Generally, modulation can for instance be mediated by interfering with binding of proteins to the RNA, such as for instance blocking binding of proteins, or recruiting RNA binding proteins. Indeed, modulations can be ensured at different levels such as splicing, transport, localization, translation and turnover of the mRNA. Similarly in the context of therapy, it can be envisaged to address (pathogenic) malfunctioning at each of these levels by using RNA-specific targeting molecules. In these embodiments it is in many cases preferred that the RNA targeting protein is a "dead" CRISPR-Cas that has lost the ability to cut the RNA target but maintains its ability to bind thereto, such as the mutated forms of CRISPR-Cas described herein.

a) Alternative Splicing

Many of the human genes express multiple mRNAs as a result of alternative splicing. Different diseases have been shown to be linked to aberrant splicing leading to loss of function or gain of function of the expressed gene. While some of these diseases are caused by mutations that cause splicing defects, a number of these are not. One therapeutic option is to target the splicing mechanism directly. The RNA targeting effector proteins described herein can for instance be used to block or promote slicing, include or exclude exons and influence the expression of specific isoforms and/or stimulate the expression of alternative protein products. Such applications are described in more detail below.

A RNA targeting effector protein binding to a target RNA can sterically block access of splicing factors to the RNA sequence. The RNA targeting effector protein targeted to a splice site may block splicing at the site, optionally redirecting splicing to an adjacent site. For instance a RNA targeting effector protein binding to the 5' splice site binding can block the recruitment of the U1 component of the spliceosome, favoring the skipping of that exon. Alternatively, a RNA targeting effector protein targeted to a splicing enhancer or silencer can prevent binding of transacting regulatory splicing factors at the target site and effectively block or promote splicing. Exon exclusion can further be achieved by recruitment of ILF2/3 to precursor mRNA near an exon by an RNA targeting effector protein as described herein. As yet another example, a glycine rich domain can be attached for recruitment of hnRNP A1 and exon exclusion (Del Gatto-Konczak et al. Mol Cell Biol. 1999 January; 19(1):251-60).

In certain embodiments, through appropriate selection of gRNA, specific splice variants may be targeted, while other splice variants will not be targeted In some cases the RNA targeting effector protein can be used to promote slicing (e.g. where splicing is defective).

For instance a RNA targeting effector protein can be associated with an effector capable of stabilizing a splicing regulatory stem-loop in order to further splicing. The RNA targeting effector protein can be linked to a consensus binding site sequence for a specific splicing factor in order to recruit the protein to the target DNA.

Examples of diseases which have been associated with aberrant splicing include, but are not limited to Paraneoplastic Opsoclonus Myoclonus Ataxia (or POMA), resulting from a loss of Nova proteins which regulate splicing of proteins that function in the synapse, and Cystic Fibrosis, which is caused by defective splicing of a cystic fibrosis transmembrane conductance regulator, resulting in the production of nonfunctional chloride channels. In other diseases aberrant RNA splicing results in gain-of-function. This is the case for instance in myotonic dystrophy which is caused by a CUG triplet-repeat expansion (from 50 to >1500 repeats) in the 3'UTR of an mRNA, causing splicing defects.

The RNA targeting effector protein can be used to include an exon by recruiting a splicing factor (such as U1) to a 5'splicing site to promote excision of introns around a desired exon. Such recruitment could be mediated trough a fusion with an arginine/serine rich domain, which functions as splicing activator (Gravely B R and Maniatis T, Mol Cell. 1998 (5):765-71).

It is envisaged that the RNA targeting effector protein can be used to block the splicing machinery at a desired locus, resulting in preventing exon recognition and the expression of a different protein product. An example of a disorder that may treated is Duchenne muscular dystrophy (DMD), which is caused by mutations in the gene encoding for the dystrophin protein. Almost all DMD mutations lead to frameshifts, resulting in impaired dystrophin translation. The RNA targeting effector protein can be paired with splice junctions or exonic splicing enhancers (ESEs) thereby preventing exon recognition, resulting in the translation of a partially functional protein. This converts the lethal Duchenne phenotype into the less severe Becker phenotype.

b) RNA Modification

RNA editing is a natural process whereby the diversity of gene products of a given sequence is increased by minor modification in the RNA. Typically, the modification involves the conversion of adenosine (A) to inosine (I), resulting in an RNA sequence which is different from that encoded by the genome. RNA modification is generally ensured by the ADAR enzyme, whereby the pre-RNA target forms an imperfect duplex RNA by base-pairing between the exon that contains the adenosine to be edited and an intronic non-coding element. A classic example of A-I editing is the glutamate receptor GluR-B mRNA, whereby the change results in modified conductance properties of the channel (Higuchi M, et al. Cell. 1993; 75:1361-70).

In humans, a heterozygous functional-null mutation in the ADAR1 gene leads to a skin disease, human pigmentary genodermatosis (Miyamura Y, et al. Am J Hum Genet. 2003; 73:693-9). It is envisaged that the RNA targeting effector proteins of the present invention can be used to correct malfunctioning RNA modification.

c) Polyadenylation

Polyadenylation of an mRNA is important for nuclear transport, translation efficiency and stability of the mRNA, and all of these, as well as the process of polyadenylation, depend on specific RBPs. Most eukaryotic mRNAs receive a 3' poly(A) tail of about 200 nucleotides after transcription. Polyadenylation involves different RNA-binding protein complexes which stimulate the activity of a poly(A)polymerase (Minvielle-Sebastia L et al. Curr Opin Cell Biol. 1999; 11:352-7). It is envisaged that the RNA-targeting effector proteins provided herein can be used to interfere with or promote the interaction between the RNA-binding proteins and RNA.

Examples of diseases which have been linked to defective proteins involved in polyadenylation are oculopharyngeal muscular dystrophy (OPMD) (Brais B, et al. Nat Genet. 1998; 18:164-7).

d) RNA Export

After pre-mRNA processing, the mRNA is exported from the nucleus to the cytoplasm. This is ensured by a cellular mechanism which involves the generation of a carrier complex, which is then translocated through the nuclear pore and releases the mRNA in the cytoplasm, with subsequent recycling of the carrier.

Overexpression of proteins (such as TAP) which play a role in the export of RNA has been found to increase export of transcripts that are otherwise inefficiently exported in *Xenopus* (Katahira J, et al. EMBO J. 1999; 18:2593-609).

e) mRNA Localization mRNA localization ensures spatially regulated protein production. Localization of transcripts to a specific region of the cell can be ensured by localization elements. In particular embodiments, it is envisaged that the effector proteins described herein can be used to target localization elements to the RNA of interest. The effector proteins can be designed to bind the target transcript and shuttle them to a location in the cell determined by its peptide signal tag. More particularly for instance, a RNA targeting effector protein fused to a nuclear localization signal (NLS) can be used to alter RNA localization.

Further examples of localization signals include the zipcode binding protein (ZBP1) which ensures localization of β-actin to the cytoplasm in several asymmetric cell types, KDEL retention sequence (localization to endoplasmic reticulum), nuclear export signal (localization to cytoplasm), mitochondrial targeting signal (localization to mitochondria), peroxisomal targeting signal (localization to peroxisome) and m6A marking/YTHDF2 (localization to p-bodies). Other approaches that are envisaged are fusion of the RNA targeting effector protein with proteins of known localization (for instance membrane, synapse).

Alternatively, the effector protein according to the invention may for instance be used in localization-dependent knockdown. By fusing the effector protein to an appropriate localization signal, the effector is targeted to a particular cellular compartment. Only target RNAs residing in this compartment will effectively be targeted, whereas otherwise identical targets, but residing in a different cellular compartment will not be targeted, such that a localization dependent knockdown can be established.

f) Translation

The RNA targeting effector proteins described herein can be used to enhance or repress translation. It is envisaged that upregulating translation is a very robust way to control cellular circuits. Further, for functional studies a protein translation screen can be favorable over transcriptional upregulation screens, which have the shortcoming that upregulation of transcript does not translate into increased protein production.

It is envisaged that the RNA targeting effector proteins described herein can be used to bring translation initiation factors, such as EIF4G in the vicinity of the 5' untranslated repeat (5'UTR) of a messenger RNA of interest to drive translation (as described in De Gregorio et al. EMBO J. 1999; 18(17):4865-74 for a non-reprogrammable RNA binding protein). As another example GLD2, a cytoplasmic poly(A) polymerase, can be recruited to the target mRNA by an RNA targeting effector protein. This would allow for directed polyadenylation of the target mRNA thereby stimulating translation.

Similarly, the RNA targeting effector proteins envisaged herein can be used to block translational repressors of mRNA, such as ZBP1 (Huttelmaier S, et al. Nature. 2005; 438:512-5). By binding to translation initiation site of a target RNA, translation can be directly affected.

In addition, fusing the RNA targeting effector proteins to a protein that stabilizes mRNAs, e.g. by preventing degradation thereof such as RNase inhibitors, it is possible to increase protein production from the transcripts of interest.

It is envisaged that the RNA targeting effector proteins described herein can be used to repress translation by binding in the 5' UTR regions of a RNA transcript and preventing the ribosome from forming and beginning translation.

Further, the RNA targeting effector protein can be used to recruit Caf1, a component of the CCR4-NOT deadenylase complex, to the target mRNA, resulting in deadenylation or the target transcript and inhibition of protein translation.

For instance, the RNA targeting effector protein of the invention can be used to increase or decrease translation of therapeutically relevant proteins. Examples of therapeutic applications wherein the RNA targeting effector protein can be used to downregulate or upregulate translation are in amyotrophic lateral sclerosis (ALS) and cardiovascular disorders. Reduced levels of the glial glutamate transporter EAAT2 have been reported in ALS motor cortex and spinal cord, as well as multiple abnormal EAAT2 mRNA transcripts in ALS brain tissue. Loss of the EAAT2 protein and function thought to be the main cause of excitotoxicity in ALS. Restoration of EAAT2 protein levels and function may provide therapeutic benefit. Hence, the RNA targeting effector protein can be beneficially used to upregulate the expression of EAAT2 protein, e.g. by blocking translational repressors or stabilizing mRNA as described above. Apolipoprotein A1 is the major protein component of high density lipoprotein (HDL) and ApoA1 and HDL are generally considered as atheroprotective. It is envisaged that the RNA targeting effector protein can be beneficially used to upregulate the expression of ApoA1, e.g. by blocking translational repressors or stabilizing mRNA as described above.

g) mRNA Turnover

Translation is tightly coupled to mRNA turnover and regulated mRNA stability. Specific proteins have been described to be involved in the stability of transcripts (such as the ELAV/Hu proteins in neurons, Keene J D, 1999, Proc Natl Acad Sci USA. 96:5-7) and tristetraprolin (TTP). These proteins stabilize target mRNAs by protecting the messages from degradation in the cytoplasm (Peng S S et al., 1988, EMBO J. 17:3461-70).

It can be envisaged that the RNA-targeting effector proteins of the present invention can be used to interfere with or to promote the activity of proteins acting to stabilize mRNA transcripts, such that mRNA turnover is affected. For instance, recruitment of human TTP to the target RNA using the RNA targeting effector protein would allow for adenylate-uridylate-rich element (AU-rich element) mediated translational repression and target degradation. AU-rich elements are found in the 3' UTR of many mRNAs that code for proto-oncogenes, nuclear transcription factors, and cytokines and promote RNA stability. As another example, the RNA targeting effector protein can be fused to HuR, another mRNA stabilization protein (Hinman M N and Lou H, Cell Mol Life Sci 2008; 65:3168-81), and recruit it to a target transcript to prolong its lifetime or stabilize short-lived mRNA.

It is further envisaged that the RNA-targeting effector proteins described herein can be used to promote degradation of target transcripts. For instance, m6A methyltransferase can be recruited to the target transcript to localize the transcript to P-bodies leading to degradation of the target.

As yet another example, an RNA targeting effector protein as described herein can be fused to the non-specific endonuclease domain PilT N-terminus (PIN), to recruit it to a target transcript and allow degradation thereof.

Patients with paraneoplastic neurological disorder (PND)-associated encephalomyelitis and neuropathy are patients who develop autoantibodies against Hu-proteins in tumors outside of the central nervous system (Szabo A et al. 1991, Cell.; 67:325-33 which then cross the blood-brain barrier. It can be envisaged that the RNA-targeting effector proteins of the present invention can be used to interfere with the binding of auto-antibodies to mRNA transcripts.

Patients with dystrophy type 1 (DM1), caused by the expansion of (CUG)n in the 3' UTR of dystrophia myotonica-protein kinase (DMPK) gene, are characterized by the accumulation of such transcripts in the nucleus. It is envisaged that the RNA targeting effector proteins of the invention fused with an endonuclease targeted to the (CUG)n repeats could inhibit such accumulation of aberrant transcripts.

h) Interaction with Multi-Functional Proteins

Some RNA-binding proteins bind to multiple sites on numerous RNAs to function in diverse processes. For instance, the hnRNP A1 protein has been found to bind exonic splicing silencer sequences, antagonizing the splicing factors, associate with telomere ends (thereby stimulating telomere activity) and bind miRNA to facilitate Drosha-mediated processing thereby affecting maturation. It is envisaged that the RNA-binding effector proteins of the present invention can interfere with the binding of RNA-binding proteins at one or more locations.

i) RNA Folding

RNA adopts a defined structure in order to perform its biological activities. Transitions in conformation among alternative tertiary structures are critical to most RNA-mediated processes. However, RNA folding can be associated with several problems. For instance, RNA may have a tendency to fold into, and be upheld in, improper alternative conformations and/or the correct tertiary structure may not be sufficiently thermodynamically favored over alternative structures. The RNA targeting effector protein, in particular a cleavage-deficient or dead RNA targeting protein, of the invention may be used to direct folding of (m)RNA and/or capture the correct tertiary structure thereof.

Use of RNA-Targeting Effector Protein in Modulating Cellular Status

In certain embodiments CRISPR-Cas in a complex with crRNA is activated upon binding to target RNA and subsequently cleaves any nearby ssRNA targets (i.e. "collateral" or "bystander" effects). CRISPR-Cas, once primed by the cognate target, can cleave other (non-complementary) RNA molecules. Such promiscuous RNA cleavage could potentially cause cellular toxicity, or otherwise affect cellular physiology or cell status.

Accordingly, in certain embodiments, the non-naturally occurring or engineered composition, vector system, or delivery systems as described herein are used for or are for use in induction of cell dormancy. In certain embodiments, the non-naturally occurring or engineered composition, vector system, or delivery systems as described herein are used for or are for use in induction of cell cycle arrest. In certain embodiments, the non-naturally occurring or engineered composition, vector system, or delivery systems as described herein are used for or are for use in reduction of cell growth and/or cell proliferation, In certain embodiments, the non-naturally occurring or engineered composition, vector system, or delivery systems as described herein are used for or are for use in induction of cell anergy. In certain embodiments, the non-naturally occurring or engineered composition, vector system, or delivery systems as described herein are used for or are for use in induction of cell apoptosis. In certain embodiments, the non-naturally occurring or engineered composition, vector system, or delivery systems as described herein are used for or are for use in induction of cell necrosis. In certain embodiments, the non-naturally occurring or engineered composition, vector system, or delivery systems as described herein are used for or are for use in induction of cell death. In certain embodiments, the non-naturally occurring or engineered composition, vector system, or delivery systems as described herein are used for or are for use in induction of programmed cell death.

In certain embodiments, the invention relates to a method for induction of cell dormancy comprising introducing or inducing the non-naturally occurring or engineered composition, vector system, or delivery systems as described herein. In certain embodiments, the invention relates to a method for induction of cell cycle arrest comprising introducing or inducing the non-naturally occurring or engineered composition, vector system, or delivery systems as described herein. In certain embodiments, the invention relates to a method for reduction of cell growth and/or cell proliferation comprising introducing or inducing the non-naturally occurring or engineered composition, vector system, or delivery systems as described herein. In certain embodiments, the invention relates to a method for induction of cell anergy comprising introducing or inducing the non-naturally occurring or engineered composition, vector system, or delivery systems as described herein. In certain embodiments, the invention relates to a method for induction of cell apoptosis comprising introducing or inducing the non-naturally occurring or engineered composition, vector system, or delivery systems as described herein. In certain embodiments, the invention relates to a method for induction of cell necrosis comprising introducing or inducing the non-naturally occurring or engineered composition, vector system, or delivery systems as described herein. In certain embodiments, the invention relates to a method for induction of cell death comprising introducing or inducing the non-naturally occurring or engineered composition, vector system, or delivery systems as described herein. In certain embodiments, the invention relates to a method for induction of programmed cell death comprising introducing or inducing the non-naturally occurring or engineered composition, vector system, or delivery systems as described herein.

The methods and uses as described herein may be therapeutic or prophylactic and may target particular cells, cell (sub)populations, or cell/tissue types. In particular, the methods and uses as described herein may be therapeutic or prophylactic and may target particular cells, cell (sub) populations, or cell/tissue types expressing one or more target sequences, such as one or more particular target RNA (e.g. ss RNA). Without limitation, target cells may for instance be cancer cells expressing a particular transcript, e.g. neurons of a given class, (immune) cells causing e.g. autoimmunity, or cells infected by a specific (e.g. viral) pathogen, etc.

Accordingly, in certain embodiments, the invention relates to a method for treating a pathological condition characterized by the presence of undesirable cells (host cells), comprising introducing or inducing the non-naturally occurring or engineered composition, vector system, or delivery systems as described herein. In certain embodiments, the invention relates the use of the non-naturally occurring or engineered composition, vector system, or delivery systems as described herein for treating a pathological condition characterized by the presence of undesirable cells (host cells). In certain embodiments, the invention relates the non-naturally occurring or engineered composition, vector system, or delivery systems as described herein for use in treating a pathological condition characterized by the presence of undesirable cells (host cells). It is to be understood that preferably the CRISPR-Cas system targets a target specific for the undesirable cells. In certain embodiments, the invention relates to the use of the non-naturally occurring or engineered composition, vector system, or delivery systems as described herein for treating, preventing, or alleviating cancer. In certain embodiments, the invention relates to the non-naturally occurring or engineered composition, vector system, or delivery systems as described herein for use in treating, preventing, or alleviating cancer. In certain embodiments, the invention relates to a method for treating, preventing, or alleviating cancer comprising introducing or inducing the non-naturally occurring or engineered composition, vector system, or delivery systems as described herein. It is to be understood that preferably the CRISPR-Cas system targets a target specific for the cancer cells. In certain embodiments, the invention relates to the use of the non-naturally occurring or engineered composition, vector system, or delivery systems as described herein for treating, preventing, or alleviating infection of cells by a pathogen. In certain embodiments, the invention relates to the non-naturally occurring or engineered composition, vector system, or delivery systems as described herein for use in treating, preventing, or alleviating infection of cells by a pathogen. In certain embodiments, the invention relates to a method for treating, preventing, or alleviating infection of cells by a pathogen comprising introducing or inducing the non-naturally occurring or engineered composition, vector system, or delivery systems as described herein. It is to be understood that preferably the CRISPR-Cas system targets a target specific for the cells infected by the pathogen (e.g. a pathogen derived target). In certain embodiments, the invention relates to the use of the non-naturally occurring or engineered composition, vector system, or delivery systems as described herein for treating, preventing, or alleviating an autoimmune disorder. In certain embodiments, the invention relates to the non-naturally occurring or engineered composition, vector system, or delivery systems as described herein for use in treating, preventing, or alleviating an autoimmune disorder. In certain embodiments, the invention relates to a method for treating, preventing, or alleviating an autoimmune disorder comprising introducing or inducing the non-naturally occurring or engineered composition, vector system, or delivery systems as described herein. It is to be understood that preferably the CRISPR-Cas system targets a target specific for the cells responsible for the autoimmune disorder (e.g. specific immune cells).

Use of RNA-Targeting Effector Protein in RNA Detection

It is further envisaged that the RNA targeting effector protein can be used in Northern blot assays. Northern blotting involves the use of electrophoresis to separate RNA samples by size. The RNA targeting effector protein can be used to specifically bind and detect the target RNA sequence.

A RNA targeting effector protein can be fused to a fluorescent protein (such as GFP) and used to track RNA localization in living cells. More particularly, the RNA targeting effector protein can be inactivated in that it no longer cleaves RNA. In particular embodiments, it is envisaged that a split RNA targeting effector protein can be used, whereby the signal is dependent on the binding of both subproteins, in order to ensure a more precise visualization. Alternatively, a split fluorescent protein can be used that is reconstituted when multiple RNA targeting effector protein complexes bind to the target transcript. It is further envisaged that a transcript is targeted at multiple binding sites along the mRNA so the fluorescent signal can amplify the true signal and allow for focal identification. As yet another alternative, the fluorescent protein can be reconstituted form a split intein.

RNA targeting effector proteins are for instance suitably used to determine the localization of the RNA or specific splice variants, the level of mRNA transcript, up- or down-regulation of transcripts and disease-specific diagnosis. The RNA targeting effector proteins can be used for visualization of RNA in (living) cells using e.g. fluorescent microscopy or flow cytometry, such as fluorescence-activated cell sorting (FACS) which allows for high-throughput screening of cells and recovery of living cells following cell sorting. Further, expression levels of different transcripts can be assessed simultaneously under stress, e.g. inhibition of cancer growth using molecular inhibitors or hypoxic conditions on cells. Another application would be to track localization of transcripts to synaptic connections during a neural stimulus using two photon microscopy.

In certain embodiments, the components or complexes according to the invention as described herein can be used in multiplexed error-robust fluorescence in situ hybridization (MERFISH; Chen et al. Science; 2015; 348(6233)), such as for instance with (fluorescently) labeled CRISPR-Cas effectors.

In Vitro Apex Labeling

Cellular processes depend on a network of molecular interactions among protein, RNA, and DNA. Accurate detection of protein-DNA and protein-RNA interactions is key to understanding such processes. In vitro proximity labeling technology employs an affinity tag combined with e.g. a photoactivatable probe to label polypeptides and RNAs in the vicinity of a protein or RNA of interest in vitro. After UV irradiation the photoactivatable group reacts with proteins and other molecules that are in close proximity to the tagged molecule, thereby labelling them. Labelled interacting molecules can subsequently be recovered and identified. The RNA targeting effector protein of the invention can for instance be used to target a probe to a selected RNA sequence.

These applications could also be applied in animal models for in vivo imaging of disease relevant applications or difficult-to culture cell types.

Use of RNA-Targeting Effector Protein in RNA Origami/In Vitro Assembly Lines—Combinatorics RNA origami refers to nanoscale folded structures for creating two-dimensional or three-dimensional structures using RNA as integrated template. The folded structure is encoded in the RNA and the shape of the resulting RNA is thus determined by the synthesized RNA sequence (Geary, et al. 2014. Science, 345 (6198). pp. 799-804). The RNA origami may act as scaffold for arranging other components, such as proteins, into complexes. The RNA targeting effector protein of the invention can for instance be used to target proteins of interest to the RNA origami using a suitable guide RNA.

These applications could also be applied in animal models for in vivo imaging of disease relevant applications or difficult-to culture cell types.

Use of RNA-Targeting Effector Protein in RNA Isolation or Purification, Enrichment or Depletion It is further envisaging that the RNA targeting effector protein when complexed to RNA can be used to isolate and/or purify the RNA. The RNA targeting effector protein can for instance be fused to an affinity tag that can be used to isolate and/or purify the RNA-RNA targeting effector protein complex. Such applications are for instance useful in the analysis of gene expression profiles in cells.

In particular embodiments, it can be envisaged that the RNA targeting effector proteins can be used to target a specific noncoding RNA (ncRNA) thereby blocking its activity, providing a useful functional probe. In certain embodiments, the effector protein as described herein may be used to specifically enrich for a particular RNA (including but not limited to increasing stability, etc.), or alternatively to specifically deplete a particular RNA (such as without limitation for instance particular splice variants, isoforms, etc.).

Interrogation of lincRNA Function and Other Nuclear RNAs

Current RNA knockdown strategies such as siRNA have the disadvantage that they are mostly limited to targeting cytosolic transcripts since the protein machinery is cytosolic. The advantage of a RNA targeting effector protein of the present invention, an exogenous system that is not essential to cell function, is that it can be used in any compartment in the cell. By fusing a NLS signal to the RNA targeting effector protein, it can be guided to the nucleus, allowing nuclear RNAs to be targeted. It is for instance envisaged to probe the function of lincRNAs. Long intergenic non-coding RNAs (lincRNAs) are a vastly underexplored area of research. Most lincRNAs have as of yet unknown functions which could be studies using the RNA targeting effector protein of the invention.

Identification of RNA Binding Proteins

Identifying proteins bound to specific RNAs can be useful for understanding the roles of many RNAs. For instance, many lincRNAs associate with transcriptional and epigenetic regulators to control transcription. Understanding what proteins bind to a given lincRNA can help elucidate the components in a given regulatory pathway. A RNA targeting effector protein of the invention can be designed to recruit a biotin ligase to a specific transcript in order to label locally bound proteins with biotin. The proteins can then be pulled down and analyzed by mass spectrometry to identify them.

Assembly of Complexes on RNA and Substrate Shuttling

RNA targeting effector proteins of the invention can further be used to assemble complexes on RNA. This can be achieved by functionalizing the RNA targeting effector protein with multiple related proteins (e.g. components of a particular synthesis pathway). Alternatively, multiple RNA targeting effector proteins can be functionalized with such different related proteins and targeted to the same or adjacent target RNA. Useful application of assembling complexes on RNA are for instance facilitating substrate shuttling between proteins.

Synthetic Biology

The development of biological systems has a wide utility, including in clinical applications. It is envisaged that the programmable RNA targeting effector proteins of the invention can be used fused to split proteins of toxic domains for targeted cell death, for instance using cancer-linked RNA as target transcript. Further, pathways involving protein-protein interaction can be influenced in synthetic biological systems with e.g. fusion complexes with the appropriate effectors such as kinases or other enzymes.

Protein Splicing: Inteins

Protein splicing is a post-translational process in which an intervening polypeptide, referred to as an intein, catalyzes its own excision from the polypeptides flacking it, referred to as exteins, as well as subsequent ligation of the exteins. The assembly of two or more RNA targeting effector proteins as described herein on a target transcript could be used to direct the release of a split intein (Topilina and Mills Mob DNA. 2014 Feb. 4; 5(1):5), thereby allowing for direct computation of the existence of a mRNA transcript and subsequent release of a protein product, such as a metabolic enzyme or a transcription factor (for downstream actuation of transcription pathways). This application may have significant relevance in synthetic biology (see above) or large-scale bioproduction (only produce product under certain conditions).

Inducible, Dosed and Self-Inactivating Systems

In one embodiment, fusion complexes comprising an RNA targeting effector protein of the invention and an effector component are designed to be inducible, for instance light inducible or chemically inducible. Such inducibility allows for activation of the effector component at a desired moment in time.

Light inducibility is for instance achieved by designing a fusion complex wherein CRY2 PHR/CIBN pairing is used for fusion. This system is particularly useful for light induction of protein interactions in living cells (Konermann S, et al. Nature. 2013; 500:472-476).

Chemical inducibility is for instance provided for by designing a fusion complex wherein FKBP/FRB (FK506 binding protein/FKBP rapamycin binding) pairing is used for fusion. Using this system rapamycin is required for binding of proteins (Zetsche et al. Nat Biotechnol. 2015; 33(2):139-42 describes the use of this system for Cas9).

Further, when introduced in the cell as DNA, the RNA targeting effector protein of the inventions can be modulated by inducible promoters, such as tetracycline or doxycycline controlled transcriptional activation (Tet-On and Tet-Off expression system), hormone inducible gene expression system such as for instance an ecdysone inducible gene expression system and an arabinose-inducible gene expression system. When delivered as RNA, expression of the RNA targeting effector protein can be modulated via a riboswitch, which can sense a small molecule like tetracycline (as described in Goldfless et al. Nucleic Acids Res. 2012; 40(9):e64).

In one embodiment, the delivery of the RNA targeting effector protein of the invention can be modulated to change the amount of protein or crRNA in the cell, thereby changing the magnitude of the desired effect or any undesired off-target effects.

In one embodiment, the RNA targeting effector proteins described herein can be designed to be self-inactivating. When delivered to a cell as RNA, either mRNA or as a replication RNA therapeutic (Wrobleska et al Nat Biotechnol. 2015 August; 33(8): 839-841), they can self-inactivate expression and subsequent effects by destroying the own RNA, thereby reducing residency and potential undesirable effects.

For further in vivo applications of RNA targeting effector proteins as described herein, reference is made to Mackay J P et al (Nat Struct Mol Biol. 2011 March; 18(3):256-61), Nelles et al (Bioessays. 2015 July; 37(7):732-9) and Abil Z and Zhao H (Mol Biosyst. 2015 October; 11(10):2658-65), which are incorporated herein by reference. In particular, the following applications are envisaged in certain embodiments of the invention, preferably in certain embodiments by using catalytically inactive CRISPR-Cas: enhancing translation (e.g. CRISPR-Cas—translation promotion factor fusions (e.g. eIF4 fusions)); repressing translation (e.g. gRNA targeting ribosome binding sites); exon skipping (e.g. gRNAs targeting splice donor and/or acceptor sites); exon inclusion (e.g. gRNA targeting a particular exon splice donor and/or acceptor site to be included or CRISPR-Cas fused to or recruiting spliceosome components (e.g. U1 snRNA)); accessing RNA localization (e.g. CRISPR-Cas—marker fusions (e.g. EGFP fusions)); altering RNA localization (e.g. CRISPR-Cas—localization signal fusions (e.g. NLS or NES fusions)); RNA degradation (in this case no catalytically inactive CRISPR-Cas is to be used if relied on the activity of CRISPR-Cas, alternatively and for increased specificity, a split CRISPR-Cas may be used); inhibition of non-coding RNA function (e.g. miRNA), such as by degradation or binding of gRNA to functional sites (possibly titrating out at specific sites by relocalization by CRISPR-Cas-signal sequence fusions).

As described herein before and demonstrated in the Examples, CRISPR-Cas function is robust to 5' or 3' extensions of the crRNA and to extension of the crRNA loop. It is therefore envisaging that MS2 loops and other recruitment domains can be added to the crRNA without affecting complex formation and binding to target transcripts. Such modifications to the crRNA for recruitment of various effector domains are applicable in the uses of a RNA targeted effector proteins described above.

CRISPR-Cas is capable of mediating resistance to RNA phages. It is therefore envisaged that CRISPR-Cas can be used to immunize, e.g. animals, humans and plants, against RNA-only pathogens, including but not limited to Ebola virus and Zika virus.

In certain embodiments, CRISPR-Cas can process (cleave) its own array. This applies to both the wildtype CRISPR-Cas protein and the mutated CRISPR-Cas protein containing one or more mutated amino acid residues as herein-discussed. It is therefore envisaged that multiple crRNAs designed for different target transcripts and/or applications can be delivered as a single pre-crRNA or as a single transcript driven by one promotor. Such method of delivery has the advantages that it is substantially more compact, easier to synthesize and easier to delivery in viral systems. It will be understood that exact amino acid positions may vary for orthologues of a herein CRISPR-Cas can be adequately determined by protein alignment, as is known in the art, and as described herein elsewhere. Aspects of the invention also encompass methods and uses of the compositions and systems described herein in genome engineering, e.g. for altering or manipulating the expression of one or more genes or the one or more gene products, in prokaryotic or eukaryotic cells, in vitro, in vivo or ex vivo.

In an aspect, the invention provides methods and compositions for modulating, e.g., reducing, expression of a target RNA in cells. In the subject methods, a CRISPR-Cas system of the invention is provided that interferes with transcription, stability, and/or translation of an RNA.

In certain embodiments, an effective amount of CRISPR-Cas system is used to cleave RNA or otherwise inhibit RNA expression. In this regard, the system has uses similar to siRNA and shRNA, thus can also be substituted for such methods. The method includes, without limitation, use of a CRISPR-Cas system as a substitute for e.g., an interfering ribonucleic acid (such as an siRNA or shRNA) or a transcription template thereof, e.g., a DNA encoding an shRNA. The CRISPR-Cas system is introduced into a target cell, e.g., by being administered to a mammal that includes the target cell.

Advantageously, a CRISPR-Cas system of the invention is specific. For example, whereas interfering ribonucleic acid (such as an siRNA or shRNA) polynucleotide systems are plagued by design and stability issues and off-target binding, a CRISPR-Cas system of the invention can be designed with high specificity.

In an aspect of the invention, novel RNA targeting systems also referred to as RNA- or RNA-targeting CRISPR systems of the present application are based on herein-identified CRISPR-Cas proteins which do not require the generation of customized proteins to target specific RNA sequences but rather a single enzyme can be programmed by a RNA molecule to recognize a specific RNA target, in other words the enzyme can be recruited to a specific RNA target using said RNA molecule.

In some embodiments, one or more elements of a nucleic acid-targeting system is derived from a particular organism comprising an endogenous CRISPR RNA-targeting system. In certain embodiments, the CRISPR RNA-targeting system is found in *Eubacterium* and *Ruminococcus*. In certain embodiments, the effector protein comprises targeted and collateral ssRNA cleavage activity. In certain embodiments, the effector protein comprises dual HEPN domains. In certain embodiments, the effector protein lacks a counterpart to the Helical-1 domain of Cas13a. In certain embodiments, the effector protein is smaller than previously characterized class 2 CRISPR effectors, with a median size of 928 aa. This median size is 190 aa (17%) less than that of Cas13c, more than 200 aa (18%) less than that of Cas13b, and more than 300 aa (26%) less than that of Cas13a. In certain embodiments, the effector protein has no requirement for a flanking sequence (e.g., PFS, PAM).

In certain embodiments, the effector protein locus structures include a WYL domain containing accessory protein (so denoted after three amino acids that were conserved in the originally identified group of these domains; see, e.g., WYL domain IPR026881). In certain embodiments, the WYL domain accessory protein comprises at least one helix-turn-helix (HTH) or ribbon-helix-helix (RHH) DNA-binding domain. In certain embodiments, the WYL domain containing accessory protein increases both the targeted and the collateral ssRNA cleavage activity of the RNA-targeting effector protein. In certain embodiments, the WYL domain containing accessory protein comprises an N-terminal RHH domain, as well as a pattern of primarily hydrophobic conserved residues, including an invariant tyrosine-leucine doublet corresponding to the original WYL motif. In certain embodiments, the WYL domain containing accessory protein is WYL1. WYL1 is a single WYL-domain protein associated primarily with *Ruminococcus.*

In other example embodiments, the Type VI RNA-targeting Cas enzyme is Cas 13d. In certain embodiments, Cas13d is *Eubacterium* siraeum DSM 15702 (EsCas13d) or *Ruminococcus* sp. N15. MGS-57 (RspCas13d) (see, e.g., Yan et al., Cas13d Is a Compact RNA-Targeting Type VI CRISPR Effector Positively Modulated by a WYL-Domain-Containing Accessory Protein, Molecular Cell (2018), doi.org/10.1016/j.molcel.2018.02.028). RspCas13d and EsCas13d have no flanking sequence requirements (e.g., PFS, PAM).

Application of the CRISPR-Cas Proteins in Optimized Functional RNA Targeting Systems In an aspect the invention provides a system for specific delivery of functional components to the RNA environment. This can be ensured using the CRISPR systems comprising the RNA targeting effector proteins of the present invention which allow specific targeting of different components to RNA. More particularly such components include activators or repressors, such as activators or repressors of RNA translation, degradation, etc. Applications of this system are described elsewhere herein.

According to one aspect the invention provides non-naturally occurring or engineered composition comprising a guide RNA comprising a guide sequence capable of hybridizing to a target sequence in a genomic locus of interest in a cell, wherein the guide RNA is modified by the insertion of one or more distinct RNA sequence(s) that bind an adaptor protein. In particular embodiments, the RNA sequences may bind to two or more adaptor proteins (e.g. aptamers), and wherein each adaptor protein is associated with one or more functional domains. The guide RNAs of the CRISPR-Cas enzymes described herein are shown to be amenable to modification of the guide sequence. In particular embodiments, the guide RNA is modified by the insertion of distinct RNA sequence(s) 5' of the direct repeat, within the direct repeat, or 3' of the guide sequence. When there is more than one functional domain, the functional domains can be same or different, e.g., two of the same or two different activators or repressors. In an aspect the invention provides a herein-discussed composition, wherein the one or more functional domains are attached to the RNA targeting enzyme so that upon binding to the target RNA the functional domain is in a spatial orientation allowing for the functional domain to function in its attributed function; In an aspect the invention provides a herein-discussed composition, wherein the composition comprises a CRISPR-Cas complex having at least three functional domains, at least one of which is associated with the RNA targeting enzyme and at least two of which are associated with the gRNA.

Accordingly, in an aspect the invention provides non-naturally occurring or engineered CRISPR-Cas complex composition comprising the guide RNA as herein-discussed and a CRISPR-Cas which is an RNA targeting enzyme, wherein optionally the RNA targeting enzyme comprises at least one mutation, such that the RNA targeting enzyme has no more than 5% of the nuclease activity of the enzyme not having the at least one mutation, and optionally one or more comprising at least one or more nuclear localization sequences. In particular embodiments, the guide RNA is additionally or alternatively modified so as to still ensure binding of the RNA targeting enzyme but to prevent cleavage by the RNA targeting enzyme (as detailed elsewhere herein).

In particular embodiments, the RNA targeting enzyme is a CRISPR-Cas protein which has a diminished nuclease activity of at least 97%, or 100% as compared with the CRISPR-Cas enzyme not having the at least one mutation. In an aspect the invention provides a herein-discussed composition, wherein the CRISPR-Cas enzyme comprises two or more mutations as otherwise herein-discussed.

In particular embodiments, an RNA targeting system is provided as described herein above comprising two or more functional domains. In particular embodiments, the two or more functional domains are heterologous functional domain. In particular embodiments, the system comprises an adaptor protein which is a fusion protein comprising a functional domain, the fusion protein optionally comprising a linker between the adaptor protein and the functional domain. In particular embodiments, the linker includes a GlySer linker. Additionally or alternatively, one or more functional domains are attached to the RNA effector protein by way of a linker, optionally a GlySer linker. In particular embodiments, the one or more functional domains are attached to the RNA targeting enzyme through one or both of the HEPN domains.

In an aspect the invention provides a herein-discussed composition, wherein the one or more functional domains associated with the adaptor protein or the RNA targeting enzyme is a domain capable of activating or repressing RNA translation. In an aspect the invention provides a herein-discussed composition, wherein at least one of the one or more functional domains associated with the adaptor protein have one or more activities comprising methylase activity, demethylase activity, transcription activation activity, transcription repression activity, transcription release factor activity, histone modification activity, DNA integration activity RNA cleavage activity, DNA cleavage activity or nucleic acid binding activity, or molecular switch activity or chemical inducibility or light inducibility.

In an aspect the invention provides a herein-discussed composition comprising an aptamer sequence. In particular embodiments, the aptamer sequence is two or more aptamer sequences specific to the same adaptor protein. In an aspect the invention provides a herein-discussed composition, wherein the aptamer sequence is two or more aptamer sequences specific to different adaptor protein. In an aspect the invention provides a herein-discussed composition, wherein the adaptor protein comprises MS2, PP7, Qβ, F2, GA, fr, JP501, M12, R17, BZ13, JP34, JP500, KU1, M11, MX1, TW18, VK, SP, FI, ID2, NL95, TW19, AP205, ϕCb5, ϕCb8r, ϕCb12r, ϕCb23r, 7s, PRR1. Accordingly, in particular embodiments, the aptamer is selected from a binding protein specifically binding any one of the adaptor proteins listed above. In an aspect the invention provides a herein-discussed composition, wherein the cell is a eukaryotic cell. In an aspect the invention provides a herein-discussed composition, wherein the eukaryotic cell is a mammalian cell, a plant cell or a yeast cell, whereby the mammalian cell is optionally a mouse cell. In an aspect the invention provides a herein-discussed composition, wherein the mammalian cell is a human cell.

In an aspect the invention provides a herein above-discussed composition wherein there is more than one guide RNA or gRNA or crRNA, and these target different sequences whereby when the composition is employed, there is multiplexing. In an aspect the invention provides a composition wherein there is more than one guide RNA or gRNA or crRNA modified by the insertion of distinct RNA sequence(s) that bind to one or more adaptor proteins.

In an aspect the invention provides a herein-discussed composition wherein one or more adaptor proteins associated with one or more functional domains is present and bound to the distinct RNA sequence(s) inserted into the guide RNA(s).

In an aspect the invention provides a herein-discussed composition wherein the guide RNA is modified to have at least one non-coding functional loop; e.g., wherein the at least one non-coding functional loop is repressive; for instance, wherein at least one non-coding functional loop comprises Alu.

In an aspect the invention provides a method for modifying gene expression comprising the administration to a host or expression in a host in vivo of one or more of the compositions as herein-discussed.

In an aspect the invention provides a herein-discussed method comprising the delivery of the composition or nucleic acid molecule(s) coding therefor, wherein said nucleic acid molecule(s) are operatively linked to regulatory sequence(s) and expressed in vivo. In an aspect the invention provides a herein-discussed method wherein the expression in vivo is via a lentivirus, an adenovirus, or an AAV.

In an aspect the invention provides a mammalian cell line of cells as herein-discussed, wherein the cell line is, optionally, a human cell line or a mouse cell line. In an aspect the invention provides a transgenic mammalian model, optionally a mouse, wherein the model has been transformed with a herein-discussed composition or is a progeny of said transformant.

In an aspect the invention provides a nucleic acid molecule(s) encoding guide RNA or the RNA targeting CRISPR-Cas complex or the composition as herein-discussed. In an aspect the invention provides a vector comprising: a nucleic acid molecule encoding a guide RNA (gRNA) or crRNA comprising a guide sequence capable of hybridizing to an RNA target sequence in a cell, wherein the direct repeat of the gRNA or crRNA is modified by the insertion of distinct RNA sequence(s) that bind(s) to two or more adaptor proteins, and wherein each adaptor protein is associated with one or more functional domains; or, wherein the gRNA is modified to have at least one non-coding functional loop. In an aspect the invention provides vector(s) comprising nucleic acid molecule(s) encoding: non-naturally occurring or engineered CRISPR-Cas complex composition comprising the gRNA or crRNA herein-discussed, and an RNA targeting enzyme, wherein optionally the RNA targeting enzyme comprises at least one mutation, such that the RNA targeting enzyme has no more than 5% of the nuclease activity of the RNA targeting enzyme not having the at least one mutation, and optionally one or more comprising at least one or more nuclear localization sequences. In an aspect a vector can further comprise regulatory element(s) operable in a eukaryotic cell operably linked to the nucleic acid molecule encoding the guide RNA (gRNA) or crRNA and/or the nucleic acid molecule encoding the RNA targeting enzyme and/or the optional nuclear localization sequence(s).

In one aspect, the invention provides a kit comprising one or more of the components described herein. In some embodiments, the kit comprises a vector system as described herein and instructions for using the kit.

In an aspect the invention provides a method of screening for gain of function (GOF) or loss of function (LOF) or for screening non-coding RNAs or potential regulatory regions (e.g. enhancers, repressors) comprising the cell line of as herein-discussed or cells of the model herein-discussed containing or expressing the RNA targeting enzyme and introducing a composition as herein-discussed into cells of the cell line or model, whereby the gRNA or crRNA includes either an activator or a repressor, and monitoring for GOF or LOF respectively as to those cells as to which the introduced gRNA or crRNA includes an activator or as to those cells as to which the introduced gRNA or crRNA includes a repressor.

In an aspect the invention provides a library of non-naturally occurring or engineered compositions, each comprising a RNA targeting CRISPR guide RNA (gRNA) or crRNA comprising a guide sequence capable of hybridizing to a target RNA sequence of interest in a cell, an RNA targeting enzyme, wherein the RNA targeting enzyme comprises at least one mutation, such that the RNA targeting enzyme has no more than 5% of the nuclease activity of the RNA targeting enzyme not having the at least one mutation, wherein the gRNA or crRNA is modified by the insertion of distinct RNA sequence(s) that bind to one or more adaptor proteins, and wherein the adaptor protein is associated with one or more functional domains, wherein the composition comprises one or more or two or more adaptor proteins, wherein the each protein is associated with one or more functional domains, and wherein the gRNAs or crRNAs comprise a genome wide library comprising a plurality of RNA targeting guide RNAs (gRNAs) or crRNAs. In an aspect the invention provides a library as herein-discussed, wherein the RNA targeting RNA targeting enzyme has a diminished nuclease activity of at least 97%, or 100% as compare with the RNA targeting enzyme not having the at least one mutation. In an aspect the invention provides a library as herein-discussed, wherein the adaptor protein is a fusion protein comprising the functional domain. In an aspect the invention provides a library as herein discussed, wherein the gRNA or crRNA is not modified by the insertion of distinct RNA sequence(s) that bind to the one or two or more adaptor proteins. In an aspect the invention provides a library as herein discussed, wherein the one or two or more functional domains are associated with the RNA targeting enzyme. In an aspect the invention provides a library as herein discussed, wherein the cell population of cells is a population of eukaryotic cells. In an aspect the invention provides a library as herein discussed, wherein the eukaryotic cell is a mammalian cell, a plant cell or a yeast cell. In an aspect the invention provides a library as herein discussed, wherein the mammalian cell is a human cell. In an aspect the invention provides a library as herein discussed, wherein the population of cells is a population of embryonic stem (ES) cells.

In an aspect the invention provides a library as herein discussed, wherein the targeting is of about 100 or more RNA sequences. In an aspect the invention provides a library as herein discussed, wherein the targeting is of about 1000 or more RNA sequences. In an aspect the invention provides a library as herein discussed, wherein the targeting is of about 20,000 or more sequences. In an aspect the invention provides a library as herein discussed, wherein the targeting is of the entire transcriptome. In an aspect the invention provides a library as herein discussed, wherein the targeting is of a panel of target sequences focused on a relevant or desirable pathway. In an aspect the invention provides a library as herein discussed, wherein the pathway is an immune pathway. In an aspect the invention provides a library as herein discussed, wherein the pathway is a cell division pathway.

In one aspect, the invention provides a method of generating a model eukaryotic cell comprising a gene with modified expression. In some embodiments, a disease gene is any gene associated an increase in the risk of having or developing a disease. In some embodiments, the method comprises (a) introducing one or more vectors encoding the components of the system described herein above into a eukaryotic cell, and (b) allowing a CRISPR complex to bind to a target polynucleotide so as to modify expression of a gene, thereby generating a model eukaryotic cell comprising modified gene expression.

The structural information provided herein allows for interrogation of guide RNA or crRNA interaction with the target RNA and the RNA targeting enzyme permitting engineering or alteration of guide RNA structure to optimize functionality of the entire RNA targeting CRISPR-Cas system. For example, the guide RNA or crRNA may be extended, without colliding with the RNA targeting protein by the insertion of adaptor proteins that can bind to RNA. These adaptor proteins can further recruit effector proteins or fusions which comprise one or more functional domains.

An aspect of the invention is that the above elements are comprised in a single composition or comprised in individual compositions. These compositions may advantageously be applied to a host to elicit a functional effect on the genomic level.

The skilled person will understand that modifications to the guide RNA or crRNA which allow for binding of the adapter+functional domain but not proper positioning of the adapter+functional domain (e.g. due to steric hindrance within the three dimension structure of the CRISPR-Cas complex) are modifications which are not intended. The one or more modified guide RNA or crRNA may be modified, by introduction of a distinct RNA sequence(s) 5' of the direct repeat, within the direct repeat, or 3' of the guide sequence.

The modified guide RNA or crRNA, the inactivated RNA targeting enzyme (with or without functional domains), and the binding protein with one or more functional domains, may each individually be comprised in a composition and administered to a host individually or collectively. Alternatively, these components may be provided in a single composition for administration to a host. Administration to a host may be performed via viral vectors known to the skilled person or described herein for delivery to a host (e.g. lentiviral vector, adenoviral vector, AAV vector). As explained herein, use of different selection markers (e.g. for lentiviral gRNA or crRNA selection) and concentration of gRNA or crRNA (e.g. dependent on whether multiple gRNAs or crRNAs are used) may be advantageous for eliciting an improved effect.

Using the provided compositions, the person skilled in the art can advantageously and specifically target single or multiple loci with the same or different functional domains to elicit one or more genomic events. The compositions may be applied in a wide variety of methods for screening in libraries in cells and functional modeling in vivo (e.g. gene activation of lincRNA and identification of function; gain-of-function modeling; loss-of-function modeling; the use the compositions of the invention to establish cell lines and transgenic animals for optimization and screening purposes).

The current invention comprehends the use of the compositions of the current invention to establish and utilize conditional or inducible CRISPR-Cas RNA targeting events. (See, e.g., Platt et al., Cell (2014), dx.doi.org/10.1016/j.cell.2014.09.014, or PCT patent publications cited herein, such as WO 2014/093622 (PCT/US2013/074667), which are not believed prior to the present invention or application).

Delivery of Functional Effectors

CRISPR-Cas13 knockdown allows for temporary reduction of gene expression through the use of artificial transcription factors, e.g., via mutating residues in cleavage domain(s) of the Cas13 protein results in the generation of a catalytically inactive Cas13 protein. A catalytically inactive Cas13 complexes with a guide RNA or crRNA and localizes to the RNA sequence specified by that guide RNA's or crRNA's targeting domain, however, it does not cleave the target. Fusion of the inactive Cas13 protein to an effector domain, e.g., a transcription repression domain, enables recruitment of the effector to any site specified by the guide RNA.

Optimized Functional RNA Targeting Systems

In an aspect the invention thus provides a system for specific delivery of functional components to the RNA environment. This can be ensured using the CRISPR systems comprising the RNA targeting effector proteins of the present invention which allow specific targeting of different components to RNA. More particularly such components include activators or repressors, such as activators or repressors of RNA translation, degradation, etc.

According to one aspect the invention provides non-naturally occurring or engineered composition comprising a guide RNA or crRNA comprising a guide sequence capable of hybridizing to a target sequence of interest in a cell, wherein the guide RNA or crRNA is modified by the insertion of one or more distinct RNA sequence(s) that bind an adaptor protein. In particular embodiments, the RNA sequences may bind to two or more adaptor proteins (e.g. aptamers), and wherein each adaptor protein is associated with one or more functional domains. When there is more than one functional domain, the functional domains can be same or different, e.g., two of the same or two different activators or repressors. In an aspect the invention provides a herein-discussed composition, wherein the one or more functional domains are attached to the RNA targeting enzyme so that upon binding to the target RNA the functional domain is in a spatial orientation allowing for the functional domain to function in its attributed function; In an aspect the invention provides a herein-discussed composition, wherein the composition comprises a CRISPR-Cas13 complex having at least three functional domains, at least one of which is associated with the RNA targeting enzyme and at least two of which are associated with the gRNA or crRNA.

Application of RNA Targeting-CRISPR System to Plants and Yeast

Definitions

In general, the term "plant" relates to any various photosynthetic, eukaryotic, unicellular or multicellular organism of the kingdom Plantae characteristically growing by cell division, containing chloroplasts, and having cell walls comprised of cellulose. The term plant encompasses monocotyledonous and dicotyledonous plants. Specifically, the plants are intended to comprise without limitation angiosperm and gymnosperm plants such as acacia, alfalfa, amaranth, apple, apricot, artichoke, ash tree, asparagus, avocado, banana, barley, beans, beet, birch, beech, blackberry, blueberry, broccoli, Brussel's sprouts, cabbage, canola, cantaloupe, carrot, cassava, cauliflower, cedar, a cereal, celery, chestnut, cherry, Chinese cabbage, citrus, clementine, clover, coffee, corn, cotton, cowpea, cucumber, cypress, eggplant, elm, endive, eucalyptus, fennel, figs, fir, geranium, grape, grapefruit, groundnuts, ground cherry, gum hemlock, hickory, kale, kiwifruit, kohlrabi, larch, lettuce, leek, lemon, lime, locust, pine, maidenhair, maize, mango, maple, melon, millet, mushroom, mustard, nuts, oak, oats, oil palm, okra, onion, orange, an ornamental plant or flower or tree, papaya, palm, parsley, parsnip, pea, peach, peanut, pear, peat, pepper, persimmon, pigeon pea, pine, pineapple, plantain, plum, pomegranate, potato, pumpkin, radicchio, radish, rapeseed, raspberry, rice, rye, sorghum, safflower, sallow, soybean, spinach, spruce, squash, strawberry, sugar beet, sugarcane, sunflower, sweet potato, sweet corn, tangerine, tea, tobacco, tomato, trees, triticale, turf grasses, turnips, vine, walnut, watercress, watermelon, wheat, yams, yew, and zucchini. The term plant also encompasses Algae, which are mainly photoautotrophs unified primarily by their lack of roots, leaves and other organs that characterize higher plants.

The methods for modulating gene expression using the RNA targeting system as described herein can be used to confer desired traits on essentially any plant. A wide variety of plants and plant cell systems may be engineered for the desired physiological and agronomic characteristics described herein using the nucleic acid constructs of the present disclosure and the various transformation methods mentioned above. In preferred embodiments, target plants and plant cells for engineering include, but are not limited to, those monocotyledonous and dicotyledonous plants, such as crops including grain crops (e.g., wheat, maize, rice, millet, barley), fruit crops (e.g., tomato, apple, pear, strawberry, orange), forage crops (e.g., alfalfa), root vegetable crops (e.g., carrot, potato, sugar beets, yam), leafy vegetable crops (e.g., lettuce, spinach); flowering plants (e.g., petunia, rose, chrysanthemum), conifers and pine trees (e.g., pine fir, spruce); plants used in phytoremediation (e.g., heavy metal accumulating plants); oil crops (e.g., sunflower, rape seed) and plants used for experimental purposes (e.g., *Arabidopsis*). Thus, the methods and CRISPR-Cas systems can be used over a broad range of plants, such as for example with dicotyledonous plants belonging to the orders Magniolales, Illiciales, Laurales, Piperales, Aristochiales, Nymphaeales, Ranunculales, Papeverales, Sarraceniaceae, Trochodendrales, Hamamelidales, Eucomiales, Leitneriales, Myricales, Fagales, Casuarinales, Caryophyllales, Batales, Polygonales, Plumbaginales, Dilleniales, Theales, Malvales, Urticales, Lecythidales, Violales, Salicales, Capparales, Ericales, Diapensales, Ebenales, Primulales, Rosales, Fabales, Podostemales, Haloragales, Myrtales, Cornales, Proteales, San tales, Rafflesiales, Celastrales, Euphorbiales, Rhamnales, Sapindales, Juglandales, Geraniales, Polygalales, Umbellales, Gentianales, Polemoniales, Lamiales, Plantaginales, Scrophulariales, Campanulales, Rubiales, Dipsacales, and Asterales; the methods and CRISPR-Cas systems can be used with monocotyledonous plants such as those belonging to the orders Alismatales, Hydrocharitales, Najadales, Triuridales, Commelinales, Eriocaulales, Restionales, Poales, Juncales, Cyperales, Typhales, Bromeliales, Zingiberales, Arecales, Cyclanthales, Pandanales, Arales, Lilliales, and Orchid ales, or with plants belonging to Gymnospermae, e.g those belonging to the orders Pinales, Ginkgoales, Cycadales, Araucariales, Cupressales and Gnetales.

The RNA targeting CRISPR systems and methods of use described herein can be used over a broad range of plant species, included in the non-limitative list of dicot, monocot or gymnosperm genera hereunder: *Atropa, Alseodaphne, Anacardium, Arachis, Beilschmiedia, Brassica, Carthamus, Cocculus, Croton, Cucumis, Citrus, Citrullus, Capsicum, Catharanthus, Cocos, Coffea, Cucurbita, Daucus, Duguetia, Eschscholzia, Ficus, Fragaria, Glaucium, Glycine, Gossypium, Helianthus, Hevea, Hyoscyamus, Lactuca, Landolphia, Linum, Litsea, Lycopersicon, Lupinus, Manihot, Majorana, Malus, Medicago, Nicotiana, Olea, Parthenium, Papaver, Persea, Phaseolus, Pistacia, Pisum, Pyrus, Prunus, Raphanus, Ricinus, Senecio, Sinomenium, Stephania, Sinapis, Solanum, Theobroma, Trifolium, Trigonella, Vicia, Vinca, Vilis*, and *Vigna*; and the genera *Allium, Andropogon, Aragrostis, Asparagus, Avena, Cynodon, Elaeis, Festuca, Festulolium, Heterocallis, Hordeum, Lemna, Lolium, Musa, Oryza, Panicum, Pannesetum, Phleum, Poa, Secale, Sorghum, Triticum, Zea, Abies, Cunninghamia, Ephedra, Picea, Pinus*, and *Pseudotsuga.*

The RNA targeting CRISPR systems and methods of use can also be used over a broad range of "algae" or "algae cells"; including for example algea selected from several eukaryotic phyla, including the Rhodophyta (red algae), Chlorophyta (green algae), Phaeophyta (brown algae), Bacillariophyta (diatoms), Eustigmatophyta and dinoflagellates as well as the prokaryotic phylum Cyanobacteria (blue-green algae). The term "algae" includes for example algae selected from: *Amphora, Anabaena, Anikstrodesmis, Botryococcus, Chaetoceros, Chlamydomonas, Chlorella, Chlorococcum, Cyclotella, Cylindrotheca, Dunaliella, Emiliana, Euglena, Hematococcus, Isochrysis, Monochrysis, Monoraphidium, Nannochloris, Nannnochloropsis, Navicula, Nephrochloris, Nephroselmis, Nitzschia, Nodularia, Nostoc, Oochromonas, Oocystis, Oscillartoria, Pavlova, Phaeodactylum, Playtmonas, Pleurochrysis, Porhyra, Pseudoanabaena, Pyramimonas, Stichococcus, Synechococcus, Synechocystis, Tetraselmis, Thalassiosira*, and *Trichodesmium.*

A part of a plant, i.e., a "plant tissue" may be treated according to the methods of the present invention to produce an improved plant. Plant tissue also encompasses plant cells. The term "plant cell" as used herein refers to individual units of a living plant, either in an intact whole plant or in an isolated form grown in in vitro tissue cultures, on media or agar, in suspension in a growth media or buffer or as a part of higher organized unites, such as, for example, plant tissue, a plant organ, or a whole plant.

A "protoplast" refers to a plant cell that has had its protective cell wall completely or partially removed using, for example, mechanical or enzymatic means resulting in an intact biochemical competent unit of living plant that can reform their cell wall, proliferate and regenerate grow into a whole plant under proper growing conditions.

The term "transformation" broadly refers to the process by which a plant host is genetically modified by the introduction of DNA by means of Agrobacteria or one of a variety of chemical or physical methods. As used herein, the term "plant host" refers to plants, including any cells, tissues, organs, or progeny of the plants. Many suitable plant tissues or plant cells can be transformed and include, but are not limited to, protoplasts, somatic embryos, pollen, leaves, seedlings, stems, calli, stolons, microtubers, and shoots. A plant tissue also refers to any clone of such a plant, seed, progeny, propagule whether generated sexually or asexually, and descendants of any of these, such as cuttings or seed.

The term "transformed" as used herein, refers to a cell, tissue, organ, or organism into which a foreign DNA molecule, such as a construct, has been introduced. The introduced DNA molecule may be integrated into the genomic DNA of the recipient cell, tissue, organ, or organism such that the introduced DNA molecule is transmitted to the subsequent progeny. In these embodiments, the "transformed" or "transgenic" cell or plant may also include progeny of the cell or plant and progeny produced from a breeding program employing such a transformed plant as a parent in a cross and exhibiting an altered phenotype resulting from the presence of the introduced DNA molecule. Preferably, the transgenic plant is fertile and capable of transmitting the introduced DNA to progeny through sexual reproduction.

The term "progeny", such as the progeny of a transgenic plant, is one that is born of, begotten by, or derived from a plant or the transgenic plant. The introduced DNA molecule may also be transiently introduced into the recipient cell such that the introduced DNA molecule is not inherited by subsequent progeny and thus not considered "transgenic". Accordingly, as used herein, a "non-transgenic" plant or plant cell is a plant which does not contain a foreign DNA stably integrated into its genome.

The term "plant promoter" as used herein is a promoter capable of initiating transcription in plant cells, whether or not its origin is a plant cell. Exemplary suitable plant promoters include, but are not limited to, those that are obtained from plants, plant viruses, and bacteria such as *Agrobacterium* or *Rhizobium* which comprise genes expressed in plant cells.

As used herein, a "fungal cell" refers to any type of eukaryotic cell within the kingdom of fungi. Phyla within the kingdom of fungi include Ascomycota, Basidiomycota, Blastocladiomycota, Chytridiomycota, Glomeromycota, Microsporidia, and Neocallimastigomycota. Fungal cells may include yeasts, molds, and filamentous fungi. In some embodiments, the fungal cell is a yeast cell.

As used herein, the term "yeast cell" refers to any fungal cell within the phyla Ascomycota and Basidiomycota. Yeast cells may include budding yeast cells, fission yeast cells, and mold cells. Without being limited to these organisms, many types of yeast used in laboratory and industrial settings are part of the phylum Ascomycota. In some embodiments, the yeast cell is an *S. cerervisiae, Kluyveromyces marxianus*, or *Issatchenkia orientalis* cell. Other yeast cells may include without limitation *Candida* spp. (e.g., *Candida albicans*), *Yarrowia* spp. (e.g., *Yarrowia lipolytica*), *Pichia* spp. (e.g., *Pichia pastoris*), *Kluyveromyces* spp. (e.g., *Kluyveromyces lactis* and *Kluyveromyces marxianus*), *Neurospora* spp. (e.g., *Neurospora crassa*), *Fusarium* spp. (e.g., *Fusarium oxysporum*), and *Issatchenkia* spp. (e.g., *Issatchenkia orientalis*, a.k.a. *Pichia kudriavzevii* and *Candida acidothermophilum*). In some embodiments, the fungal cell is a filamentous fungal cell. As used herein, the term "filamentous fungal cell" refers to any type of fungal cell that grows in filaments, i.e., hyphae or mycelia. Examples of filamentous fungal cells may include without limitation *Aspergillus* spp. (e.g., *Aspergillus niger*), *Trichoderma* spp. (e.g., *Trichoderma reesei*), *Rhizopus* spp. (e.g., *Rhizopus oryzae*), and *Mortierella* spp. (e.g., *Mortierella isabellina*).

In some embodiments, the fungal cell is an industrial strain. As used herein, "industrial strain" refers to any strain of fungal cell used in or isolated from an industrial process, e.g., production of a product on a commercial or industrial scale. Industrial strain may refer to a fungal species that is typically used in an industrial process, or it may refer to an isolate of a fungal species that may be also used for non-industrial purposes (e.g., laboratory research). Examples of industrial processes may include fermentation (e.g., in production of food or beverage products), distillation, biofuel production, production of a compound, and production of a polypeptide. Examples of industrial strains may include, without limitation, JAY270 and ATCC4124.

In some embodiments, the fungal cell is a polyploid cell. As used herein, a "polyploid" cell may refer to any cell whose genome is present in more than one copy. A polyploid cell may refer to a type of cell that is naturally found in a polyploid state, or it may refer to a cell that has been induced to exist in a polyploid state (e.g., through specific regulation, alteration, inactivation, activation, or modification of meiosis, cytokinesis, or DNA replication). A polyploid cell may refer to a cell whose entire genome is polyploid, or it may refer to a cell that is polyploid in a particular genomic locus of interest. Without wishing to be bound to theory, it is thought that the abundance of guide RNA may more often be a rate-limiting component in genome engineering of polyploid cells than in haploid cells, and thus the methods using the CRISPR-Cas CRISPR system described herein may take advantage of using a certain fungal cell type.

In some embodiments, the fungal cell is a diploid cell. As used herein, a "diploid" cell may refer to any cell whose genome is present in two copies. A diploid cell may refer to a type of cell that is naturally found in a diploid state, or it may refer to a cell that has been induced to exist in a diploid state (e.g., through specific regulation, alteration, inactivation, activation, or modification of meiosis, cytokinesis, or DNA replication). For example, the *S. cerevisiae* strain S228C may be maintained in a haploid or diploid state. A diploid cell may refer to a cell whose entire genome is diploid, or it may refer to a cell that is diploid in a particular genomic locus of interest. In some embodiments, the fungal cell is a haploid cell. As used herein, a "haploid" cell may refer to any cell whose genome is present in one copy. A haploid cell may refer to a type of cell that is naturally found in a haploid state, or it may refer to a cell that has been induced to exist in a haploid state (e.g., through specific regulation, alteration, inactivation, activation, or modification of meiosis, cytokinesis, or DNA replication). For example, the *S. cerevisiae* strain S228C may be maintained in a haploid or diploid state. A haploid cell may refer to a cell whose entire genome is haploid, or it may refer to a cell that is haploid in a particular genomic locus of interest.

As used herein, a "yeast expression vector" refers to a nucleic acid that contains one or more sequences encoding an RNA and/or polypeptide and may further contain any desired elements that control the expression of the nucleic acid(s), as well as any elements that enable the replication and maintenance of the expression vector inside the yeast cell. Many suitable yeast expression vectors and features thereof are known in the art; for example, various vectors and techniques are illustrated in in Yeast Protocols, 2nd edition, Xiao, W., ed. (Humana Press, New York, 2007) and Buckholz, R. G. and Gleeson, M. A. (1991) Biotechnology (NY) 9(11): 1067-72. Yeast vectors may contain, without limitation, a centromeric (CEN) sequence, an autonomous replication sequence (ARS), a promoter, such as an RNA Polymerase III promoter, operably linked to a sequence or gene of interest, a terminator such as an RNA polymerase III terminator, an origin of replication, and a marker gene (e.g., auxotrophic, antibiotic, or other selectable markers). Examples of expression vectors for use in yeast may include plasmids, yeast artificial chromosomes, 2 plasmids, yeast integrative plasmids, yeast replicative plasmids, shuttle vectors, and episomal plasmids.

Stable Integration of RNA Targeting Crisp System Components in the Genome of Plants and Plant Cells In particular embodiments, it is envisaged that the polynucleotides encoding the components of the RNA targeting CRISPR system are introduced for stable integration into the genome of a plant cell. In these embodiments, the design of the transformation vector or the expression system can be adjusted depending on when, where and under what conditions the guide RNA and/or the RNA targeting gene(s) are expressed.

In particular embodiments, it is envisaged to introduce the components of the RNA targeting CRISPR system stably into the genomic DNA of a plant cell. Additionally or alternatively, it is envisaged to introduce the components of the RNA targeting CRISPR system for stable integration into the DNA of a plant organelle such as, but not limited to a plastid, e mitochondrion or a chloroplast.

The expression system for stable integration into the genome of a plant cell may contain one or more of the following elements: a promoter element that can be used to express the guide RNA and/or RNA targeting enzyme in a plant cell; a 5' untranslated region to enhance expression; an intron element to further enhance expression in certain cells, such as monocot cells; a multiple-cloning site to provide convenient restriction sites for inserting the one or more guide RNAs and/or the RNA targeting gene sequences and other desired elements; and a 3' untranslated region to provide for efficient termination of the expressed transcript.

The elements of the expression system may be on one or more expression constructs which are either circular such as a plasmid or transformation vector, or non-circular such as linear double stranded DNA.

In a particular embodiment, a RNA targeting CRISPR expression system comprises at least:

(a) a nucleotide sequence encoding a guide RNA (gRNA) that hybridizes with a target sequence in a plant, and wherein the guide RNA comprises a guide sequence and a direct repeat sequence, and
(b) a nucleotide sequence encoding a RNA targeting protein, wherein components (a) or (b) are located on the same or on different constructs, and whereby the different nucleotide sequences can be under control of the same or a different regulatory element operable in a plant cell.

DNA construct(s) containing the components of the RNA targeting CRISPR system, may be introduced into the genome of a plant, plant part, or plant cell by a variety of conventional techniques. The process generally comprises the steps of selecting a suitable host cell or host tissue, introducing the construct(s) into the host cell or host tissue, and regenerating plant cells or plants therefrom.

In particular embodiments, the DNA construct may be introduced into the plant cell using techniques such as but not limited to electroporation, microinjection, aerosol beam injection of plant cell protoplasts, or the DNA constructs can be introduced directly to plant tissue using biolistic methods, such as DNA particle bombardment (see also Fu et al., Transgenic Res. 2000 February; 9(1):11-9). The basis of particle bombardment is the acceleration of particles coated with gene/s of interest toward cells, resulting in the penetration of the protoplasm by the particles and typically stable integration into the genome. (see e.g. Klein et al, Nature (1987), Klein et al, Bio/Technology (1992), Casas et al, Proc. Natl. Acad. Sci. USA (1993).).

In particular embodiments, the DNA constructs containing components of the RNA targeting CRISPR system may be introduced into the plant by *Agrobacterium*-mediated transformation. The DNA constructs may be combined with suitable T-DNA flanking regions and introduced into a conventional *Agrobacterium tumefaciens* host vector. The foreign DNA can be incorporated into the genome of plants by infecting the plants or by incubating plant protoplasts with *Agrobacterium* bacteria, containing one or more Ti (tumor-inducing) plasmids. (see e.g. Fraley et al., (1985), Rogers et al., (1987) and U.S. Pat. No. 5,563,055).

Plant Promoters

In order to ensure appropriate expression in a plant cell, the components of the CRISPR-Cas CRISPR system described herein are typically placed under control of a plant promoter, i.e. a promoter operable in plant cells. The use of different types of promoters is envisaged.

A constitutive plant promoter is a promoter that is able to express the open reading frame (ORF) that it controls in all or nearly all of the plant tissues during all or nearly all developmental stages of the plant (referred to as "constitutive expression"). One non-limiting example of a constitutive promoter is the cauliflower mosaic virus 35S promoter. The present invention envisages methods for modifying RNA sequences and as such also envisages regulating expression of plant biomolecules. In particular embodiments of the present invention it is thus advantageous to place one or more elements of the RNA targeting CRISPR system under the control of a promoter that can be regulated. "Regulated promoter" refers to promoters that direct gene expression not constitutively, but in a temporally- and/or spatially-regulated manner, and includes tissue-specific, tissue-preferred and inducible promoters. Different promoters may direct the expression of a gene in different tissues or cell types, or at different stages of development, or in response to different environmental conditions. In particular embodiments, one or more of the RNA targeting CRISPR components are expressed under the control of a constitutive promoter, such as the cauliflower mosaic virus 35S promoter issue-preferred promoters can be utilized to target enhanced expression in certain cell types within a particular plant tissue, for instance vascular cells in leaves or roots or in specific cells of the seed. Examples of particular promoters for use in the RNA targeting CRISPR system—are found in Kawamata et al., (1997) Plant Cell Physiol 38:792-803; Yamamoto et al., (1997) Plant J 12:255-65; Hire et al, (1992) Plant Mol Biol 20:207-18, Kuster et al, (1995) Plant Mol Biol 29:759-72, and Capana et al., (1994) Plant Mol Biol 25:681-91.

Examples of promoters that are inducible and that allow for spatiotemporal control of gene editing or gene expression may use a form of energy. The form of energy may include but is not limited to sound energy, electromagnetic radiation, chemical energy and/or thermal energy. Examples of inducible systems include tetracycline inducible promoters (Tet-On or Tet-Off), small molecule two-hybrid transcription activations systems (FKBP, ABA, etc), or light inducible systems (Phytochrome, LOV domains, or cryptochrome)., such as a Light Inducible Transcriptional Effector (LITE) that direct changes in transcriptional activity in a sequence-specific manner. The components of a light inducible system may include a RNA targeting CRISPR-Cas, a light-responsive cytochrome heterodimer (e.g. from *Arabidopsis thaliana*), and a transcriptional activation/repression domain. Further examples of inducible DNA binding proteins and methods for their use are provided in U.S. 61/736,465 and U.S. 61/721,283, which is hereby incorporated by reference in its entirety.

In particular embodiments, transient or inducible expression can be achieved by using, for example, chemical-regulated promotors, i.e. whereby the application of an exogenous chemical induces gene expression. Modulating of gene expression can also be obtained by a chemical-repressible promoter, where application of the chemical represses gene expression. Chemical-inducible promoters include, but are not limited to, the maize ln2-2 promoter, activated by benzene sulfonamide herbicide safeners (De Veylder et al., (1997) Plant Cell Physiol 38:568-77), the maize GST promoter (GST-11-27, WO93/01294), activated by hydrophobic electrophilic compounds used as pre-emergent herbicides, and the tobacco PR-1 a promoter (Ono et al., (2004) Biosci Biotechnol Biochem 68:803-7) activated by salicylic acid. Promoters which are regulated by antibiotics, such as tetracycline-inducible and tetracycline-repressible promoters (Gatz et al., (1991) Mol Gen Genet 227: 229-37; U.S. Pat. Nos. 5,814,618 and 5,789,156) can also be used herein.

Translocation to and/or Expression in Specific Plant Organelles

The expression system may comprise elements for translocation to and/or expression in a specific plant organelle.

Chloroplast Targeting

In particular embodiments, it is envisaged that the RNA targeting CRISPR system is used to specifically modify expression and/or translation of chloroplast genes or to ensure expression in the chloroplast. For this purpose use is made of chloroplast transformation methods or compartmentalization of the RNA targeting CRISPR components to the chloroplast. For instance, the introduction of genetic modifications in the plastid genome can reduce biosafety issues such as gene flow through pollen.

Methods of chloroplast transformation are known in the art and include Particle bombardment, PEG treatment, and microinjection. Additionally, methods involving the translocation of transformation cassettes from the nuclear genome to the plastid can be used as described in WO2010061186.

Alternatively, it is envisaged to target one or more of the RNA targeting CRISPR components to the plant chloroplast. This is achieved by incorporating in the expression construct a sequence encoding a chloroplast transit peptide (CTP) or plastid transit peptide, operably linked to the 5' region of the sequence encoding the RNA targeting protein. The CTP is removed in a processing step during translocation into the chloroplast. Chloroplast targeting of expressed proteins is well known to the skilled artisan (see for instance Protein Transport into Chloroplasts, 2010, Annual Review of Plant Biology, Vol. 61: 157-180). In such embodiments it is also desired to target the one or more guide RNAs to the plant chloroplast. Methods and constructs which can be used for translocating guide RNA into the chloroplast by means of a chloroplast localization sequence are described, for instance, in US 20040142476, incorporated herein by reference. Such variations of constructs can be incorporated into the expression systems of the invention to efficiently translocate the RNA targeting-guide RNA(s).

Introduction of Polynucleotides Encoding the CRISPR-RNA Targeting System in Algal Cells.

Transgenic algae (or other plants such as rape) may be particularly useful in the production of vegetable oils or biofuels such as alcohols (especially methanol and ethanol) or other products. These may be engineered to express or overexpress high levels of oil or alcohols for use in the oil or biofuel industries.

U.S. Pat. No. 8,945,839 describes a method for engineering Micro-Algae (*Chlamydomonas reinhardtii* cells) species) using Cas9. Using similar tools, the methods of the RNA targeting CRISPR system described herein can be applied on *Chlamydomonas* species and other algae. In particular embodiments, RNA targeting protein and guide RNA(s) are introduced in algae expressed using a vector that expresses RNA targeting protein under the control of a constitutive promoter such as Hsp70A-Rbc S2 or Beta2-tubulin. Guide RNA is optionally delivered using a vector containing T7 promoter. Alternatively, RNA targeting mRNA and in vitro transcribed guide RNA can be delivered to algal cells. Electroporation protocols are available to the skilled person such as the standard recommended protocol from the GeneArt *Chlamydomonas* Engineering kit.

Introduction of Polynucleotides Encoding RNA Targeting Components in Yeast Cells In particular embodiments, the invention relates to the use of the RNA targeting CRISPR system for RNA editing in yeast cells. Methods for transforming yeast cells which can be used to introduce polynucleotides encoding the RNA targeting CRISPR system components are well known to the artisan and are reviewed by Kawai et al., 2010, Bioeng Bugs. 2010 November-December; 1(6): 395-403). Non-limiting examples include transformation of yeast cells by lithium acetate treatment (which may further include carrier DNA and PEG treatment), bombardment or by electroporation.

Transient Expression of RNA Targeting Crisp System Components in Plants and Plant Cell In particular embodiments, it is envisaged that the guide RNA and/or RNA targeting gene are transiently expressed in the plant cell. In these embodiments, the RNA targeting CRISPR system can ensure modification of RNA target molecules only when both the guide RNA and the RNA targeting protein is present in a cell, such that gene expression can further be controlled. As the expression of the RNA targeting enzyme is transient, plants regenerated from such plant cells typically contain no foreign DNA. In particular embodiments the RNA targeting enzyme is stably expressed by the plant cell and the guide sequence is transiently expressed.

In particularly preferred embodiments, the RNA targeting CRISPR system components can be introduced in the plant cells using a plant viral vector (Scholthof et al. 1996, Annu Rev Phytopathol. 1996; 34:299-323). In further particular embodiments, said viral vector is a vector from a DNA virus. For example, geminivirus (e.g., cabbage leaf curl virus, bean yellow dwarf virus, wheat dwarf virus, tomato leaf curl virus, maize streak virus, tobacco leaf curl virus, or tomato golden mosaic virus) or nanovirus (e.g., *Faba* bean necrotic yellow virus). In other particular embodiments, said viral vector is a vector from an RNA virus. For example, tobravirus (e.g., tobacco rattle virus, tobacco mosaic virus), potexvirus (e.g., potato virus X), or hordeivirus (e.g., barley stripe mosaic virus). The replicating genomes of plant viruses are non-integrative vectors, which is of interest in the context of avoiding the production of GMO plants.

In particular embodiments, the vector used for transient expression of RNA targeting CRISPR constructs is for instance a pEAQ vector, which is tailored for *Agrobacterium*-mediated transient expression (Sainsbury F. et al., Plant Biotechnol J. 2009 September; 7(7):682-93) in the protoplast. Precise targeting of genomic locations was demonstrated using a modified Cabbage Leaf Curl virus (CaLCuV) vector to express gRNAs in stable transgenic plants expressing a Cas13 (see Scientific Reports 5, Article number: 14926 (2015), doi:10.1038/srep14926).

In particular embodiments, double-stranded DNA fragments encoding the guide RNA or crRNA and/or the RNA targeting gene can be transiently introduced into the plant cell. In such embodiments, the introduced double-stranded DNA fragments are provided in sufficient quantity to modify RNA molecule(s) in the cell but do not persist after a contemplated period of time has passed or after one or more cell divisions. Methods for direct DNA transfer in plants are known by the skilled artisan (see for instance Davey et al. Plant Mol Biol. 1989 September; 13(3):273-85.)

In other embodiments, an RNA polynucleotide encoding the RNA targeting protein is introduced into the plant cell, which is then translated and processed by the host cell generating the protein in sufficient quantity to modify the RNA molecule(s) cell (in the presence of at least one guide RNA) but which does not persist after a contemplated period of time has passed or after one or more cell divisions. Methods for introducing mRNA to plant protoplasts for transient expression are known by the skilled artisan (see for instance in Gallie, Plant Cell Reports (1993), 13; 119-122). Combinations of the different methods described above are also envisaged.

Delivery of RNA Targeting Crispr Components to the Plant Cell

In particular embodiments, it is of interest to deliver one or more components of the RNA targeting CRISPR system directly to the plant cell. This is of interest, inter alia, for the generation of non-transgenic plants. In particular embodiments, one or more of the RNA targeting components is prepared outside the plant or plant cell and delivered to the cell. For instance in particular embodiments, the RNA targeting protein is prepared in vitro prior to introduction to the plant cell. RNA targeting protein can be prepared by various methods known by one of skill in the art and include recombinant production. After expression, the RNA targeting protein is isolated, refolded if needed, purified and optionally treated to remove any purification tags, such as a His-tag. Once crude, partially purified, or more completely purified RNA targeting protein is obtained, the protein may be introduced to the plant cell.

In particular embodiments, the RNA targeting protein is mixed with guide RNA targeting the RNA of interest to form a pre-assembled ribonucleoprotein.

The individual components or pre-assembled ribonucleoprotein can be introduced into the plant cell via electroporation, by bombardment with RNA targeting-associated gene product coated particles, by chemical transfection or by some other means of transport across a cell membrane. For instance, transfection of a plant protoplast with a pre-assembled CRISPR ribonucleoprotein has been demonstrated to ensure targeted modification of the plant genome (as described by Woo et al. Nature Biotechnology, 2015; DOI: 10.1038/nbt.3389). These methods can be modified to achieve targeted modification of RNA molecules in the plants.

In particular embodiments, the RNA targeting CRISPR system components are introduced into the plant cells using nanoparticles. The components, either as protein or nucleic acid or in a combination thereof, can be uploaded onto or packaged in nanoparticles and applied to the plants (such as for instance described in WO 2008042156 and US 20130185823). In particular, embodiments of the invention comprise nanoparticles uploaded with or packed with DNA molecule(s) encoding the RNA targeting protein, DNA molecules encoding the guide RNA and/or isolated guide RNA as described in WO2015089419.

Further means of introducing one or more components of the RNA targeting CRISPR system to the plant cell is by using cell penetrating peptides (CPP). Accordingly, in particular, embodiments the invention comprises compositions comprising a cell penetrating peptide linked to an RNA targeting protein. In particular embodiments of the present invention, an RNA targeting protein and/or guide RNA(s) is coupled to one or more CPPs to effectively transport them inside plant protoplasts (Ramakrishna (2014, Genome Res. 2014 June; 24(6):1020-7 for Cas9 in human cells). In other embodiments, the RNA targeting gene and/or guide RNA(s) are encoded by one or more circular or non-circular DNA molecule(s) which are coupled to one or more CPPs for plant protoplast delivery. The plant protoplasts are then regenerated to plant cells and further to plants. CPPs are generally described as short peptides of fewer than 35 amino acids either derived from proteins or from chimeric sequences which are capable of transporting biomolecules across cell membrane in a receptor independent manner. CPP can be cationic peptides, peptides having hydrophobic sequences, amphipatic peptides, peptides having proline-rich and antimicrobial sequence, and chimeric or bipartite peptides (Pooga and Langel 2005). CPPs are able to penetrate biological membranes and as such trigger the movement of various biomolecules across cell membranes into the cytoplasm and to improve their intracellular routing, and hence facilitate interaction of the biolomolecule with the target. Examples of CPP include amongst others: Tat, a nuclear transcriptional activator protein required for viral replication by HIV type1, penetratin, Kaposi fibroblast growth factor (FGF) signal peptide sequence, integrin β3 signal peptide sequence; polyarginine peptide Args sequence, Guanine rich-molecular transporters, sweet arrow peptide, etc.

Target RNA Envisaged for Plant, Algae or Fungal Applications

The target RNA, i.e. the RNA of interest, is the RNA to be targeted by the present invention leading to the recruitment to, and the binding of the RNA targeting protein at, the target site of interest on the target RNA. The target RNA may be any suitable form of RNA. This may include, in some embodiments, mRNA. In other embodiments, the target RNA may include transfer RNA (tRNA) or ribosomal RNA (rRNA). In other embodiments the target RNA may include interfering RNA (RNAi), microRNA (miRNA), microswitches, microzymes, satellite RNAs and RNA viruses. The target RNA may be located in the cytoplasm of the plant cell, or in the cell nucleus or in a plant cell organelle such as a mitochondrion, chloroplast or plastid.

In particular embodiments, the RNA targeting CRISPR system is used to cleave RNA or otherwise inhibit RNA expression.

Use of RNA Targeting Crispr System for Modulating Plant Gene Expression Via RNA Modulation The RNA targeting protein may also be used, together with a suitable guide RNA, to target gene expression, via control of RNA processing. The control of RNA processing may include RNA processing reactions such as RNA splicing, including alternative splicing; viral replication (in particular of plant viruses, including virioids in plants and tRNA biosynthesis. The RNA targeting protein in combination with a suitable guide RNA may also be used to control RNA activation (RNAa). RNAa leads to the promotion of gene expression, so control of gene expression may be achieved that way through disruption or reduction of RNAa and thus less promotion of gene expression.

The RNA targeting effector protein of the invention can further be used for antiviral activity in plants, in particular against RNA viruses. The effector protein can be targeted to the viral RNA using a suitable guide RNA selective for a selected viral RNA sequence. In particular, the effector protein may be an active nuclease that cleaves RNA, such as single stranded RNA. provided is therefore the use of an RNA targeting effector protein of the invention as an antiviral agent. Examples of viruses that can be counteracted in this way include, but are not limited to, Tobacco mosaic virus (TMV), Tomato spotted wilt virus (TSWV), Cucumber mosaic virus (CMV), Potato virus Y (PVY), Cauliflower mosaic virus (CaMV) (RT virus), Plum pox virus (PPV), Brome mosaic virus (BMV) and Potato virus X (PVX).

Examples of modulating RNA expression in plants, algae or fungi, as an alternative of targeted gene modification are described herein further.

Of particular interest is the regulated control of gene expression through regulated cleavage of mRNA. This can be achieved by placing elements of the RNA targeting under the control of regulated promoters as described herein.

Use of the RNA Targeting Crispr System to Restore the Functionality of tRNA Molecules.

Pring et al describe RNA editing in plant mitochondria and chloroplasts that alters mRNA sequences to code for different proteins than the DNA. (Plant Mol. Biol. (1993) 21 (6): 1163-1170. doi:10.1007/BF00023611). In particular embodiments of the invention, the elements of the RNA targeting CRISPR system specifically targeting mitochondrial and chloroplast mRNA can be introduced in a plant or plant cell to express different proteins in such plant cell organelles mimicking the processes occurring in vivo.

Use of the RNA Targeting Crispr System as an Alternative to RNA Interference to Inhibit RNA Expression.

The RNA targeting CRISPR system has uses similar to RNA inhibition or RNA interference, thus can also be substituted for such methods. In particular embodiment, the methods of the present invention include the use of the RNA targeting CRISPR as a substitute for e.g. an interfering ribonucleic acid (such as an siRNA or shRNA or a dsRNA). Examples of inhibition of RNA expression in plants, algae or fungi as an alternative of targeted gene modification are described herein further.

Use of the RNA Targeting Crispr System to Control RNA Interference.

Control over interfering RNA or miRNA may help reduce off-target effects (OTE) seen with those approaches by reducing the longevity of the interfering RNA or miRNA in vivo or in vitro. In particular embodiments, the target RNA may include interfering RNA, i.e. RNA involved in an RNA interference pathway, such as shRNA, siRNA and so forth. In other embodiments, the target RNA may include microRNA (miRNA) or double stranded RNA (dsRNA).

In other particular embodiments, if the RNA targeting protein and suitable guide RNA(s) are selectively expressed (for example spatially or temporally under the control of a regulated promoter, for example a tissue- or cell cycle-specific promoter and/or enhancer) this can be used to 'protect' the cells or systems (in vivo or in vitro) from RNAi in those cells. This may be useful in neighboring tissues or cells where RNAi is not required or for the purposes of comparison of the cells or tissues where the effector protein and suitable guide are and are not expressed (i.e. where the RNAi is not controlled and where it is, respectively). The RNA targeting protein may be used to control or bind to molecules comprising or consisting of RNA, such as ribozymes, ribosomes or riboswitches. In embodiments of the invention, the guide RNA can recruit the RNA targeting protein to these molecules so that the RNA targeting protein is able to bind to them.

The RNA targeting CRISPR system of the invention can be applied in areas of in-planta RNAi technologies, without undue experimentation, from this disclosure, including insect pest management, plant disease management and management of herbicide resistance, as well as in plant assay and for other applications (see, for instance Kim et al., in Pesticide Biochemistry and Physiology (Impact Factor: 2.01). 01/2015; 120. DOI: 10.1016/j.pestbp.2015.01.002; Sharma et al. in Academic Journals (2015), Vol. 12(18) pp 2303-2312); Green J. M, inPest Management Science, Vol 70(9), pp 1351-1357), because the present application provides the foundation for informed engineering of the system.

Use of RNA Targeting Crispr System to Modify Riboswitches and Control Metabolic Regulation in Plants, Algae and Fungi Riboswitches (also known as aptozymes) are regulatory segments of messenger RNA that bind small molecules and in turn regulate gene expression. This mechanism allows the cell to sense the intracellular concentration of these small molecules. A particular riboswitch typically regulates its adjacent gene by altering the transcription, the translation or the splicing of this gene. Thus, in particular embodiments of the present invention, control of riboswitch activity is envisaged through the use of the RNA targeting protein in combination with a suitable guide RNA to target the riboswitch. This may be through cleavage of, or binding to, the riboswitch. In particular embodiments, reduction of riboswitch activity is envisaged. Recently, a riboswitch that binds thiamin pyrophosphate (TPP) was characterized and found to regulate thiamin biosynthesis in plants and algae. Furthermore it appears that this element is an essential regulator of primary metabolism in plants (Bocobza and Aharoni, Plant J. 2014 August; 79(4):693-703. doi: 10.1111/tpj.12540. Epub 2014 Jun. 17). TPP riboswitches are also found in certain fungi, such as in *Neurospora crassa*, where it controls alternative splicing to conditionally produce an Upstream Open Reading Frame (uORF), thereby affecting the expression of downstream genes (Cheah M T et al., (2007) Nature 447 (7143): 497-500. doi:10.1038/nature05769) The RNA targeting CRISPR system described herein may be used to manipulate the endogenous riboswitch activity in plants, algae or fungi and as such alter the expression of downstream genes controlled by it. In particular embodiments, the RNA targeting CRISP system may be used in assaying riboswitch function in vivo or in vitro and in studying its relevance for the metabolic network. In particular embodiments the RNA targeting CRISPR system may potentially be used for engineering of riboswitches as metabolite sensors in plants and platforms for gene control.

Use of RNA Targeting Crispr System in RNAi Screens for Plants, Algae or Fungi

Identifying gene products whose knockdown is associated with phenotypic changes, biological pathways can be interrogated and the constituent parts identified, via RNAi screens. In particular embodiments of the invention, control may also be exerted over or during these screens by use of the Guide 29 or Guide 30 protein and suitable guide RNA described herein to remove or reduce the activity of the RNAi in the screen and thus reinstate the activity of the (previously interfered with) gene product (by removing or reducing the interference/repression).

Use of RNA Targeting Proteins for Visualization of RNA Molecules In Vivo and In Vitro In particular embodiments, the invention provides a nucleic acid binding system. In situ hybridization of RNA with complementary probes is a powerful technique. Typically fluorescent DNA oligonucleotides are used to detect nucleic acids by hybridization. Increased efficiency has been attained by certain modifications, such as locked nucleic acids (LNAs), but there remains a need for efficient and versatile alternatives. As such, labelled elements of the RNA targeting system can be used as an alternative for efficient and adaptable system for in situ hybridization Further Applications of the RNA Targeting Crispr System in Plants and Yeasts Use of RNA Targeting CRISPR System in Biofuel Production The term “biofuel” as used herein is an alternative fuel made from plant and plant-derived resources. Renewable biofuels can be extracted from organic matter whose energy has been obtained through a process of carbon fixation or are made through the use or conversion of biomass. This biomass can be used directly for biofuels or can be converted to convenient energy containing substances by thermal conversion, chemical conversion, and biochemical conversion. This biomass conversion can result in fuel in solid, liquid, or gas form. There are two types of biofuels: bioethanol and biodiesel. Bioethanol is mainly produced by the sugar fermentation process of cellulose (starch), which is mostly derived from maize and sugar cane. Biodiesel on the other hand is mainly produced from oil crops such as rapeseed, palm, and soybean. Biofuels are used mainly for transportation.

Enhancing Plant Properties for Biofuel Production

In particular embodiments, the methods using the RNA targeting CRISPR system as described herein are used to alter the properties of the cell wall in order to facilitate access by key hydrolysing agents for a more efficient release of sugars for fermentation. In particular embodiments, the biosynthesis of cellulose and/or lignin are modified. Cellulose is the major component of the cell wall. The biosynthesis of cellulose and lignin are co-regulated. By reducing the proportion of lignin in a plant the proportion of cellulose can be increased. In particular embodiments, the methods described herein are used to downregulate lignin biosynthesis in the plant so as to increase fermentable carbohydrates. More particularly, the methods described herein are used to downregulate at least a first lignin biosynthesis gene selected from the group consisting of 4-coumarate 3-hydroxylase (C3H), phenylalanine ammonia-lyase (PAL), cinnamate 4-hydroxylase (C4H), hydroxycinnamoyl transferase (HCT), caffeic acid O-methyltransferase (COMT), caffeoyl CoA 3-O-methyltransferase (CCoAOMT), ferulate 5-hydroxylase (F5H), cinnamyl alcohol dehydrogenase (CAD), cinnamoyl CoA-reductase (CCR), 4-coumarate-CoA ligase (4CL), monolignol-lignin-specific glycosyltransferase, and aldehyde dehydrogenase (ALDH) as disclosed in WO 2008064289 A2.

In particular embodiments, the methods described herein are used to produce plant mass that produces lower levels of acetic acid during fermentation (see also WO 2010096488).

Modifying Yeast for Biofuel Production

In particular embodiments, the RNA targeting enzyme provided herein is used for bioethanol production by recombinant micro-organisms. For instance, RNA targeting enzymes can be used to engineer micro-organisms, such as yeast, to generate biofuel or biopolymers from fermentable sugars and optionally to be able to degrade plant-derived lignocellulose derived from agricultural waste as a source of fermentable sugars. More particularly, the invention provides methods whereby the RNA targeting CRISPR complex is used to modify the expression of endogenous genes required for biofuel production and/or to modify endogenous genes why may interfere with the biofuel synthesis. More particularly the methods involve stimulating the expression in a micro-organism such as a yeast of one or more nucleotide sequence encoding enzymes involved in the conversion of pyruvate to ethanol or another product of interest. In particular embodiments the methods ensure the stimulation of expression of one or more enzymes which allows the micro-organism to degrade cellulose, such as a cellulase. In yet further embodiments, the RNA targeting CRISPR complex is used to suppress endogenous metabolic pathways which compete with the biofuel production pathway.

Modifying Algae and Plants for Production of Vegetable Oils or Biofuels

Transgenic algae or other plants such as rape may be particularly useful in the production of vegetable oils or biofuels such as alcohols (especially methanol and ethanol), for instance. These may be engineered to express or overexpress high levels of oil or alcohols for use in the oil or biofuel industries.

U.S. Pat. No. 8,945,839 describes a method for engineering Micro-Algae (*Chlamydomonas reinhardtii* cells) species) using Cas9. Using similar tools, the methods of the RNA targeting CRISPR system described herein can be applied on *Chlamydomonas* species and other algae. In particular embodiments, the RNA targeting effector protein and guide RNA are introduced in algae expressed using a vector that expresses the RNA targeting effector protein under the control of a constitutive promoter such as Hsp70A-Rbc S2 or Beta2-tubulin. Guide RNA will be delivered using a vector containing T7 promoter. Alternatively, in vitro transcribed guide RNA can be delivered to algae cells. Electroporation protocol follows standard recommended protocol from the GeneArt *Chlamydomonas* Engineering kit.

Particular Applications of the RNA Targeting Enzymes in Plants

In particular embodiments, present invention can be used as a therapy for virus removal in plant systems as it is able to cleave viral RNA. Previous studies in human systems have demonstrated the success of utilizing CRISPR in targeting the single strand RNA virus, hepatitis C (A. Price, et al., Proc. Natl. Acad. Sci, 2015). These methods may also be adapted for using the RNA targeting CRISPR system in plants.

Improved Plants

The present invention also provides plants and yeast cells obtainable and obtained by the methods provided herein. The improved plants obtained by the methods described herein may be useful in food or feed production through the modified expression of genes which, for instance ensure tolerance to plant pests, herbicides, drought, low or high temperatures, excessive water, etc.

The improved plants obtained by the methods described herein, especially crops and algae may be useful in food or feed production through expression of, for instance, higher protein, carbohydrate, nutrient or vitamin levels than would normally be seen in the wildtype. In this regard, improved plants, especially pulses and tubers are preferred.

Improved algae or other plants such as rape may be particularly useful in the production of vegetable oils or biofuels such as alcohols (especially methanol and ethanol), for instance. These may be engineered to express or overexpress high levels of oil or alcohols for use in the oil or biofuel industries.

The invention also provides for improved parts of a plant. Plant parts include, but are not limited to, leaves, stems, roots, tubers, seeds, endosperm, ovule, and pollen. Plant parts as envisaged herein may be viable, nonviable, regeneratable, and/or non-regeneratable.

It is also encompassed herein to provide plant cells and plants generated according to the methods of the invention. Gametes, seeds, embryos, either zygotic or somatic, progeny or hybrids of plants comprising the genetic modification, which are produced by traditional breeding methods, are also included within the scope of the present invention. Such plants may contain a heterologous or foreign DNA sequence inserted at or instead of a target sequence. Alternatively, such plants may contain only an alteration (mutation, deletion, insertion, substitution) in one or more nucleotides. As such, such plants will only be different from their progenitor plants by the presence of the particular modification.

In an embodiment of the invention, a CRISPR-Cas system is used to engineer pathogen resistant plants, for example by creating resistance against diseases caused by bacteria, fungi or viruses. In certain embodiments, pathogen resistance can be accomplished by engineering crops to produce a CRISPR-Cas system that will be ingested by an insect pest, leading to mortality. In an embodiment of the invention, a CRISPR-Cas system is used to engineer abiotic stress tolerance. In another embodiment, a CRISPR-Cas system is used to engineer drought stress tolerance or salt stress tolerance, or cold or heat stress tolerance. Younis et al. 2014, Int. J. Biol. Sci. 10; 1150 reviewed potential targets of plant breeding methods, all of which are amenable to correction or improvement through use of a CRISPR-Cas system described herein. Some non-limiting target crops include Arabidops *Zea mays* is *thaliana, Oryza sativa* L, *Prunus domestica* L., *Gossypium hirsutum, Nicotiana rustica, Zea mays, Medicago sativa, Nicotiana benthamiana* and *Arabidopsis thaliana*

In an embodiment of the invention, a CRISPR-Cas system is used for management of crop pests. For example, a CRISPR-Cas system operable in a crop pest can be expressed from a plant host or transferred directly to the target, for example using a viral vector.

In an embodiment, the invention provides a method of efficiently producing homozygous organisms from a heterozygous non-human starting organism. In an embodiment, the invention is used in plant breeding. In another embodiment, the invention is used in animal breeding. In such embodiments, a homozygous organism such as a plant or animal is made by preventing or suppressing recombination by interfering with at least one target gene involved in double strand breaks, chromosome pairing and/or strand exchange.

CRISPR-Cas Effector Protein Complexes can be Used in Plants

The invention in some embodiments comprehends a method of modifying an cell or organism. The cell may be a prokaryotic cell or a eukaryotic cell. The cell may be a mammalian cell. The mammalian cell many be a non-human primate, bovine, porcine, rodent or mouse cell. The cell may be a non-mammalian eukaryotic cell such as poultry, fish or shrimp. The cell may also be a plant cell. The plant cell may be of a crop plant such as cassava, corn, sorghum, wheat, or rice. The plant cell may also be of an algae, tree or vegetable. The modification introduced to the cell by the present invention may be such that the cell and progeny of the cell are altered for improved production of biologic products such as an antibody, starch, alcohol or other desired cellular output. The modification introduced to the cell by the present invention may be such that the cell and progeny of the cell include an alteration that changes the biologic product produced. The system may comprise one or more different vectors. In an aspect of the invention, the effector protein is codon optimized for expression the desired cell type, preferentially a eukaryotic cell, preferably a mammalian cell or a human cell. CRISPR-Cas system(s) (e.g., single or multiplexed) can be used in conjunction with recent advances in crop genomics. Such CRISPR system(s) can be used to perform efficient and cost effective plant gene or genome or transcriptome interrogation or editing or manipulation—for instance, for rapid investigation and/or selection and/or interrogations and/or comparison and/or manipulations and/or transformation of plant genes or genomes; e.g., to create, identify, develop, optimize, or confer trait(s) or characteristic(s) to plant(s) or to transform a plant genome. There can accordingly be improved production of plants, new plants with new combinations of traits or characteristics or new plants with enhanced traits. Such CRISPR system(s) can be used with regard to plants in Site-Directed Integration (SDI) or Gene Editing (GE) or any Near Reverse Breeding (NRB) or Reverse Breeding (RB) techniques. Accordingly, reference herein to animal cells may also apply, mutatis mutandis, to plant cells unless otherwise apparent; and, the enzymes herein having reduced off-target effects and systems employing such enzymes can be used in plant applications, including those mentioned herein. Engineered plants modified by the effector protein and suitable guide (crRNA), and progeny thereof, as provided. These may include disease or drought resistant crops, such as wheat, barley, rice, soybean or corn; plants modified to remove or reduce the ability to self-pollinate (but which can instead, optionally, hybridise instead); and allergenic foods such as peanuts and nuts where the immunogenic proteins have been disabled, destroyed or disrupted by targeting via a effector protein and suitable guide. Any aspect of using classical CRIPSR-Cas systems may be adapted to use in CRISPR systems that are Cas protein agnostic, e.g. Cas13 effector protein systems.

Models of Conditions

A method of the invention may be used to create a plant, an animal or cell that may be used to model and/or study genetic or epigenetic conditions of interest, such as a through a model of mutations of interest or a disease model. As used herein, "disease" refers to a disease, disorder, or indication in a subject. For example, a method of the invention may be used to create an animal or cell that comprises a modification in one or more nucleic acid sequences associated with a disease, or a plant, animal or cell in which expression of one or more nucleic acid sequences associated with a disease are altered. Such a nucleic acid sequence may encode or be translated a disease associated protein sequence or may be a disease associated control sequence. Accordingly, it is understood that in embodiments of the invention, a plant, subject, patient, organism or cell can be a non-human subject, patient, organism or cell. Thus, the invention provides a plant, animal or cell, produced by the present methods, or a progeny thereof. The progeny may be a clone of the produced plant or animal, or may result from sexual reproduction by crossing with other individuals of the same species to introgress further desirable traits into their offspring. The cell may be in vivo or ex vivo in the cases of multicellular organisms, particularly animals or plants. In the instance where the cell is in cultured, a cell line may be established if appropriate culturing conditions are met and preferably if the cell is suitably adapted for this purpose (for instance a stem cell). Bacterial cell lines produced by the invention are also envisaged. Hence, cell lines are also envisaged. In some methods, the disease model can be used to study the effects of mutations, or more general altered, such as reduced, expression of genes or gene products on the animal or cell and development and/or progression of the disease using measures commonly used in the study of the disease. Alternatively, such a disease model is useful for studying the effect of a pharmaceutically active compound on the disease. In some methods, the disease model can be used to assess the efficacy of a potential gene therapy strategy. That is, a disease-associated RNA can be modified such that the disease development and/or progression is displayed or inhibited or reduced and then effects of a compound on the progression or inhibition or reduction are tested.

Useful in the practice of the instant invention utilizing CRISPR-Cas effector proteins and complexes thereof and nucleic acid molecules encoding same and methods using same, reference is made to: Genome-Scale CRISPR-Cas9 Knockout Screening in Human Cells. Shalem, O., Sanjana, NE., Hartenian, E., Shi, X., Scott, DA., Mikkelson, T., Heckl, D., Ebert, BL., Root, DE., Doench, JG., Zhang, F. Science December 12. (2013). [Epub ahead of print]; Published in final edited form as: Science. 2014 Jan. 3; 343 (6166): 84-87. Shalem et al. involves a new way to interrogate gene function on a genome-wide scale. Their studies showed that delivery of a genome-scale CRISPR-Cas9 knockout (GeCKO) library targeted 18,080 genes with 64,751 unique guide sequences enabled both negative and positive selection screening in human cells. First, the authors showed use of the GeCKO library to identify genes essential for cell viability in cancer and pluripotent stem cells. Next, in a melanoma model, the authors screened for genes whose loss is involved in resistance to vemurafenib, a therapeutic that inhibits mutant protein kinase BRAF. Their studies showed that the highest-ranking candidates included previously validated genes NF1 and MED12 as well as novel hitsNF2, CUL3, TADA2B, and TADA1. The authors observed a high level of consistency between independent guide RNAs targeting the same gene and a high rate of hit confirmation, and thus demonstrated the promise of genome-scale screening with Cas9. Reference is also made to US patent publication number US20140357530; and PCT Patent Publication WO2014093701, hereby incorporated herein by reference.

The term "associated with" is used here in relation to the association of the functional domain to the CRISPR-Cas effector protein or the adaptor protein. It is used in respect of how one molecule 'associates' with respect to another, for example between an adaptor protein and a functional domain, or between the CRISPR-Cas effector protein and a functional domain. In the case of such protein-protein interactions, this association may be viewed in terms of recognition in the way an antibody recognizes an epitope. Alternatively, one protein may be associated with another protein via a fusion of the two, for instance one subunit being fused to another subunit. Fusion typically occurs by addition of the amino acid sequence of one to that of the other, for instance via splicing together of the nucleotide sequences that encode each protein or subunit. Alternatively, this may essentially be viewed as binding between two molecules or direct linkage, such as a fusion protein. In any event, the fusion protein may include a linker between the two subunits of interest (i.e. between the enzyme and the functional domain or between the adaptor protein and the functional domain). Thus, in some embodiments, the CRISPR-Cas effector protein or adaptor protein is associated with a functional domain by binding thereto. In other embodiments, the CRISPR-Cas effector protein or adaptor protein is associated with a functional domain because the two are fused together, optionally via an intermediate linker.

Therapeutic Applications

The system of the invention can be applied in areas of former RNA cutting technologies, without undue experimentation, from this disclosure, including therapeutic, assay and other applications, because the present application provides the foundation for informed engineering of the system. The present invention provides for therapeutic treatment of a disease caused by overexpression of RNA, toxic RNA and/or mutated RNA (such as, for example, splicing defects or truncations). Expression of the toxic RNA may be associated with formation of nuclear inclusions and late-onset degenerative changes in brain, heart or skeletal muscle. In the best studied example, myotonic dystrophy, it appears that the main pathogenic effect of the toxic RNA is to sequester binding proteins and compromise the regulation of alternative splicing (Hum. Mol. Genet. (2006) 15 (suppl 2): R162-R169). Myotonic dystrophy [dystrophia myotonica (DM)] is of particular interest to geneticists because it produces an extremely wide range of clinical features. A partial listing would include muscle wasting, cataracts, insulin resistance, testicular atrophy, slowing of cardiac conduction, cutaneous tumors and effects on cognition. The classical form of DM, which is now called DM type 1 (DM1), is caused by an expansion of CTG repeats in the 3'-untranslated region (UTR) of DMPK, a gene encoding a cytosolic protein kinase.

The innate immune system detects viral infection primarily by recognizing viral nucleic acids inside an infected cell, referred to as DNA or RNA sensing. In vitro RNA sensing assays can be used to detect specific RNA substrates. The RNA targeting effector protein can for instance be used for RNA-based sensing in living cells. Examples of applications are diagnostics by sensing of, for examples, disease-specific RNAs. The RNA targeting effector protein of the invention can further be used for antiviral activity, in particular against RNA viruses. The effector protein can be targeted to the viral RNA using a suitable guide RNA selective for a selected viral RNA sequence. In particular, the effector protein may be an active nuclease that cleaves RNA, such as single stranded RNA. Therapeutic dosages of the enzyme system of the present invention to target RNA the above-referenced RNAs are contemplated to be about 0.1 to about 2 mg/kg the dosages may be administered sequentially with a monitored response, and repeated dosages if necessary, up to about 7 to 10 doses per patient. Advantageously, samples are collected from each patient during the treatment regimen to ascertain the effectiveness of treatment. For example, RNA samples may be isolated and quantified to determine if expression is reduced or ameliorated. Such a diagnostic is within the purview of one of skill in the art.

In some examples, the disease is caused by a G→A or C→T point mutation or a pathogenic SNP. In some examples, the disease caused by a T→C or A→G point mutation or a pathogenic SNP. For example, the disease may be cancer, haemophilia, beta-thalassemia, Marfan syndrome and Wiskott-Aldrich syndrome.

Exemplary Therapies

The present invention also contemplates use of the CRISPR-Cas system and the base editor described herein, for treatment in a variety of diseases and disorders. In some embodiments, the invention described herein relates to a method for therapy in which cells are edited ex vivo by CRISPR or the base editor to modulate at least one gene, with subsequent administration of the edited cells to a patient in need thereof. In some embodiments, the editing involves knocking in, knocking out or knocking down expression of at least one target gene in a cell. In particular embodiments, the editing inserts an exogenous, gene, minigene or sequence, which may comprise one or more exons and introns or natural or synthetic introns into the locus of a target gene, a hot-spot locus, a safe harbor locus of the gene genomic locations where new genes or genetic elements can be introduced without disrupting the expression or regulation of adjacent genes, or correction by insertions or deletions one or more mutations in DNA sequences that encode regulatory elements of a target gene. In some embodiment, the editing comprise introducing one or more point mutations in a nucleic acid (e.g., a genomic DNA) in a target cell.

In embodiments, the treatment is for disease/disorder of an organ, including liver disease, eye disease, muscle disease, heart disease, blood disease, brain disease, kidney disease, or may comprise treatment for an autoimmune disease, central nervous system disease, cancer and other proliferative diseases, neurodegenerative disorders, inflammatory disease, metabolic disorder, musculoskeletal disorder and the like.

Particular diseases/disorders include chondroplasia, achromatopsia, acid maltase deficiency, adrenoleukodystrophy, aicardi syndrome, alpha-1 antitrypsin deficiency, alpha-thalassemia, androgen insensitivity syndrome, apert syndrome, arrhythmogenic right ventricular, dysplasia, ataxia telangictasia, barth syndrome, beta-thalassemia, blue rubber bleb nevus syndrome, canavan disease, chronic granulomatous diseases (CGD), cri du chat syndrome, cystic fibrosis, dercum's disease, ectodermal dysplasia, fanconi anemia, fibrodysplasia ossificans progressive, fragile X syndrome, galactosemis, Gaucher's disease, generalized gangliosidoses (e.g., GM1), hemochromatosis, the hemoglobin C mutation in the 6th codon of beta-globin (HbC), hemophilia, Huntington's disease, Hurler Syndrome, hypophosphatasia, Klinefleter syndrome, Krabbes Disease, Langer-Giedion Syndrome, leukodystrophy, long QT syndrome, Marfan syndrome, Moebius syndrome, mucopolysaccharidosis (MPS), nail patella syndrome, nephrogenic diabetes insipdius, neurofibromatosis, Neimann-Pick disease, osteogenesis imperfecta, porphyria, Prader-Willi syndrome, progeria, Proteus syndrome, retinoblastoma, Rett syndrome, Rubinstein-Taybi syndrome, Sanfilippo syndrome, severe combined immunodeficiency (SCID), Shwachman syndrome, sickle cell disease (sickle cell anemia), Smith-Magenis syndrome, Stickler syndrome, Tay-Sachs disease, Thrombocytopenia Absent Radius (TAR) syndrome, Treacher Collins syndrome, trisomy, tuberous sclerosis, Turner's syndrome, urea cycle disorder, von Hippel-Landau disease, Waardenburg syndrome, Williams syndrome, Wilson's disease, and Wiskott-Aldrich syndrome.

In embodiments, the disease is associated with expression of a tumor antigen, e.g., a proliferative disease, a precancerous condition, a cancer, or a non-cancer related indication associated with expression of the tumor antigen, which may in some embodiments comprise a target selected from B2M, CD247, CD3D, CD3E, CD3G, TRAC, TRBC1, TRBC2, HLA-A, HLA-B, HLA-C, DCK, CD52, FKBP1A, CIITA, NLRC5, RFXANK, RFX5, RFXAP, or NR3C1, HAVCR2, LAG3, PDCD1, PD-L2, CTLA4, CEACAM (CEACAM-1, CEACAM-3 and/or CEACAM-5), VISTA, BTLA, TIGIT, LAIR1, CD160, 2B4, CD80, CD86, B7-H3 (CD113), B7-H4 (VTCN1), HVEM (TNFRSF14 or CD107), KIR, A2aR, MHC class I, MHC class II, GAL9, adenosine, and TGF beta, or PTPN11 DCK, CD52, NR3C1, LILRB1, CD19; CD123; CD22; CD30; CD171; CS-1 (also referred to as CD2 subset 1, CRACC, SLAMF7, CD319, and 19A24); C-type lectin-like molecule-1 (CLL-1 or CLECL1); CD33; epidermal growth factor receptor variant III (EGFRvIII); ganglioside G2 (GD2); ganglioside GD3 (aNeu5Ac(2-8) aNeu5Ac(2-3)bDGalp(1-4)bDGlcp(1-1)Cer); TNF receptor family member B cell maturation (BCMA); Tn antigen ((Tn Ag) or (GalNAca-Ser/Thr)); prostate-specific membrane antigen (PSMA); Receptor tyrosine kinase-like orphan receptor 1 (ROR1); Fms-Like Tyrosine Kinase 3 (FLT3); Tumor-associated glycoprotein 72 (TAG72); CD38; CD44v6; Carcinoembryonic antigen (CEA); Epithelial cell adhesion molecule (EPCAM); B7H3 (CD276); KIT (CD117); Interleukin-13 receptor subunit alpha-2 (IL-13Ra2 or CD213A2); Mesothelin; Interleukin 11 receptor alpha (IL-11Ra); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha; Receptor tyrosine-protein kinase ERBB2 (Her2/neu); n kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CAIX); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); Fucosyl GM1; sialyl Lewis adhesion molecule (sLe); ganglioside GM3 (aNeu5Ac(2-3)bDGalp(1-4)bDGlcp(1-1)Cer); transglutaminase 5 (TGS5); high molecular weight-melanoma-associated antigen (HMWMAA); o-acetyl-GD2 ganglioside (OAcGD2); Folate receptor beta; tumor endothelial marker 1 (TEM1/CD248); tumor endothelial marker 7-related (TEM7R); claudin 6 (CLDN6); thyroid stimulating hormone receptor (TSHR); G protein-coupled receptor class C group 5, member D (GPRC5D); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ESO-1); Cancer/testis antigen 2 (LAGE-la); Melanoma-associated antigen 1 (MAGE-A1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; surviving; telomerase; prostate carcinoma tumor antigen-1 (PCTA-1 or Galectin 8), melanoma antigen recognized by T cells 1 (MelanA or MART1); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin B1; v-myc avian myelocytomatosis viral oncogene neuroblastoma derived homolog (MYCN); Ras Homolog Family Member C (RhoC); Tyrosinase-related protein 2 (TRP-2); Cytochrome P450 1B1 (CYP1B1); CCCTC-Binding Factor (Zinc Finger Protein)-Like (BORIS or Brother of the Regulator of Imprinted Sites), Squamous Cell Carcinoma Antigen Recognized By T Cells 3 (SART3); Paired box protein Pax-5 (PAX5); proacrosin binding protein sp32 (OY-TES1); lymphocyte-specific protein tyrosine kinase (LCK); A kinase anchor protein 4 (AKAP-4); synovial sarcoma, X breakpoint 2 (SSX2); Receptor for Advanced Glycation Endproducts (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIR1); Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRLS); and immunoglobulin lambda-like polypeptide 1 (IGLL1), CD19, BCMA, CD70, G6PC, Dystrophin, including modification of exon 51 by deletion or excision, DMPK, CFTR (cystic fibrosis transmembrane conductance regulator). In embodiments, the targets comprise CD70, or a Knock-in of CD33 and Knock-out of B2M. In embodiments, the targets comprise a knockout of TRAC and B2M, or TRAC B2M and PD1, with or without additional target genes. In certain embodiments, the disease is cystic fibrosis with targeting of the SCNN1A gene, e.g., the non-coding or coding regions, e.g., a promoter region, or a transcribed sequence, e.g., intronic or exonic sequence, targeted knock-in at CFTR sequence within intron 2, into which, e.g., can be introduced CFTR sequence that codes for CFTR exons 3-27; and sequence within CFTR intron 10, into which sequence that codes for CFTR exons 11-27 can be introduced.

In embodiments, the disease is Metachromatic Leukodystrophy, and the target is Arylsulfatase A, the disease is Wiskott-Aldrich Syndrome and the target is Wiskott-Aldrich Syndrome protein, the disease is Adreno leukodystrophy and the target is ATP-binding cassette DI, the disease is Human Immunodeficiency Virus and the target is receptor type 5-C—C chemokine or CXCR4 gene, the disease is Beta-thalassemia and the target is Hemoglobin beta subunit, the disease is X-linked Severe Combined ID receptor subunit gamma and the target is interelukin-2 receptor subunit gamma, the disease is Multisystemic Lysosomal Storage Disorder cystinosis and the target is cystinosin, the disease is Diamon-Blackfan anemia and the target is Ribosomal protein S19, the disease is Fanconi Anemia and the target is Fanconi anemia complementation groups (e.g. FNACA, FNACB, FANCC, FANCD1, FANCD2, FANCE, FANCF, RAD51C), the disease is Shwachman-Bodian-Diamond Bodian-Diamond syndrome and the target is Shwachman syndrome gene, the disease is Gaucher's disease and the target is Glucocerebrosidase, the disease is Hemophilia A and the target is Anti-hemophiliac factor OR Factor VIII, Christmas factor, Serine protease, Factor Hemophilia B IX, the disease is Adenosine deaminase deficiency (ADA-SCID) and the target is Adenosine deaminase, the disease is GM1 gangliosidoses and the target is beta-galactosidase, the disease is Glycogen storage disease type II, Pompe disease, the disease is acid maltase deficiency acid and the target is alpha-glucosidase, the disease is Niemann-Pick disease, SMPD1-associated (Types Sphingomyelin phosphodiesterase 1 OR A and B) acid and the target is sphingomyelinase, the disease is Krabbe disease, globoid cell leukodystrophy and the target is Galactosylceramidase or galactosylceramide lipidosis and the target is galactercerebrosidease, Human leukocyte antigens DR-15, DQ-6, the disease is Multiple Sclerosis (MS) DRB1, the disease is Herpes Simplex Virus 1 or 2 and the target is knocking down of one, two or three of RS1, RL2 and/or LAT genes. In embodiments, the disease is an HPV associated cancer with treatment including edited cells comprising binding molecules, such as TCRs or antigen binding fragments thereof and antibodies and antigen-binding fragments thereof, such as those that recognize or bind human papilloma virus. The disease can be Hepatitis B with a target of one or more of PreC, C, X, PreS1, PreS2, S, P and/or SP gene(s).

In embodiments, the immune disease is severe combined immunodeficiency (SCID), Omenn syndrome, and in one aspect the target is Recombination Activating Gene 1

(RAG1) or an interleukin-7 receptor (IL7R). In particular embodiments, the disease is Transthyretin Amyloidosis (ATTR), Familial amyloid cardiomyopathy, and in one aspect, the target is the TTR gene, including one or more mutations in the TTR gene. In embodiments, the disease is Alpha-1 Antitrypsin Deficiency (AATD) or another disease in which Alpha-1 Antitrypsin is implicated, for example GvHD, Organ transplant rejection, diabetes, liver disease, COPD, Emphysema and Cystic Fibrosis, in particular embodiments, the target is SERPINA1.

In embodiments, the disease is primary hyperoxaluria, which, in certain embodiments, the target comprises one or more of Lactate dehydrogenase A (LDHA) and hydroxy Acid Oxidase 1 (HAO 1). In embodiments, the disease is primary hyperoxaluria type 1 (ph1) and other alanine-glyoxylate aminotransferase (agxt) gene related conditions or disorders, such as Adenocarcinoma, Chronic Alcoholic Intoxication, Alzheimer's Disease, Cooley's anemia, Aneurysm, Anxiety Disorders, Asthma, Malignant neoplasm of breast, Malignant neoplasm of skin, Renal Cell Carcinoma, Cardiovascular Diseases, Malignant tumor of cervix, Coronary Arteriosclerosis, Coronary heart disease, Diabetes, Diabetes Mellitus, Diabetes Mellitus Non-Insulin-Dependent, Diabetic Nephropathy, Eclampsia, Eczema, Subacute Bacterial Endocarditis, Glioblastoma, Glycogen storage disease type II, Sensorineural Hearing Loss (disorder), Hepatitis, Hepatitis A, Hepatitis B, Homocystinuria, Hereditary Sensory Autonomic Neuropathy Type 1, Hyperaldosteronism, Hypercholesterolemia, Hyperoxaluria, Primary Hyperoxaluria, Hypertensive disease, Inflammatory Bowel Diseases, Kidney Calculi, Kidney Diseases, Chronic Kidney Failure, leiomyosarcoma, Metabolic Diseases, Inborn Errors of Metabolism, Mitral Valve Prolapse Syndrome, Myocardial Infarction, Neoplasm Metastasis, Nephrotic Syndrome, Obesity, Ovarian Diseases, Periodontitis, Polycystic Ovary Syndrome, Kidney Failure, Adult Respiratory Distress Syndrome, Retinal Diseases, Cerebrovascular accident, Turner Syndrome, Viral hepatitis, Tooth Loss, Premature Ovarian Failure, Essential Hypertension, Left Ventricular Hypertrophy, Migraine Disorders, Cutaneous Melanoma, Hypertensive heart disease, Chronic glomerulonephritis, Migraine with Aura, Secondary hypertension, Acute myocardial infarction, Atherosclerosis of aorta, Allergic asthma, pineoblastoma, Malignant neoplasm of lung, Primary hyperoxaluria type I, Primary hyperoxaluria type 2, Inflammatory Breast Carcinoma, Cervix carcinoma, Restenosis, Bleeding ulcer, Generalized glycogen storage disease of infants, Nephrolithiasis, Chronic rejection of renal transplant, Urolithiasis, pricking of skin, Metabolic Syndrome X, Maternal hypertension, Carotid Atherosclerosis, Carcinogenesis, Breast Carcinoma, Carcinoma of lung, Nephronophthisis, Microalbuminuria, Familial Retinoblastoma, Systolic Heart Failure Ischemic stroke, Left ventricular systolic dysfunction, Cauda Equina Paraganglioma, Hepatocarcinogenesis, Chronic Kidney Diseases, Glioblastoma Multiforme, Non-Neoplastic Disorder, Calcium Oxalate Nephrolithiasis, Ablepharon-Macrostomia Syndrome, Coronary Artery Disease, Liver carcinoma, Chronic kidney disease stage 5, Allergic rhinitis (disorder), Crigler Najjar syndrome type 2, and Ischemic Cerebrovascular Accident. In certain embodiments, treatment is targeted to the liver. In embodiments, the gene is AGXT, with a a cytogenetic location of 2q37.3 and the genomic coordinate are on Chromosome 2 on the forward strand at position 240,868,479-240,880,502.

Treatment can also target collagen type vii alpha 1 chain (col7a1) gene related conditions or disorders, such as Malignant neoplasm of skin, Squamous cell carcinoma, Colorectal Neoplasms, Crohn Disease, Epidermolysis Bullosa, Indirect Inguinal Hernia, Pruritus, Schizophrenia, Dermatologic disorders, Genetic Skin Diseases, Teratoma, Cockayne-Touraine Disease, Epidermolysis Bullosa Acquisita, Epidermolysis Bullosa Dystrophica, Junctional Epidermolysis Bullosa, Hallopeau-Siemens Disease, Bullous Skin Diseases, Agenesis of corpus callosum, Dystrophia unguium, Vesicular Stomatitis, Epidermolysis Bullosa With Congenital Localized Absence Of Skin And Deformity Of Nails, Juvenile Myoclonic Epilepsy, Squamous cell carcinoma of esophagus, Poikiloderma of Kindler, pretibial Epidermolysis bullosa, Dominant dystrophic epidermolysis bullosa albopapular type (disorder), Localized recessive dystrophic epidermolysis bullosa, Generalized dystrophic epidermolysis bullosa, Squamous cell carcinoma of skin, Epidermolysis Bullosa Pruriginosa, Mammary Neoplasms, Epidermolysis Bullosa Simplex Superficialis, Isolated Toenail Dystrophy, Transient bullous dermolysis of the newborn, Autosomal Recessive Epidermolysis Bullosa Dystrophica Localisata Variant, and Autosomal Recessive Epidermolysis Bullosa Dystrophica Inversa.

In embodiments, the disease is acute myeloid leukemia (AML), targeting Wilms Tumor I (WTI) and HLA expressing cells. In embodiments, the therapy is T cell therapy, as described elsewhere herein, comprising engineered T cells with WTI specific TCRs. In certain embodiments, the target is CD157 in AML.

In embodiments, the disease is a blood disease. In certain embodiments, the disease is hemophilia, in one aspect the target is Factor XI. In other embodiments, the disease is a hemoglobinopathy, such as sickle cell disease, sickle cell trait, hemoglobin C disease, hemoglobin C trait, hemoglobin S/C disease, hemoglobin D disease, hemoglobin E disease, a thalassemia, a condition associated with hemoglobin with increased oxygen affinity, a condition associated with hemoglobin with decreased oxygen affinity, unstable hemoglobin disease, methemoglobinemia. Hemostasis and Factor X and XII deficiencies can also be treated. In embodiments, the target is BCL11A gene (e.g., a human BCL11a gene), a BCL11a enhancer (e.g., a human BCL11a enhancer), or a HFPH region (e.g., a human HPFH region), beta globulin, fetal hemoglobin, γ-globin genes (e.g., HBG1, HBG2, or HBG1 and HBG2), the erythroid specific enhancer of the BCL11A gene (BCL11Ae), or a combination thereof.

In embodiments, the target locus can be one or more of RAC, TRBC1, TRBC2, CD3E, CD3G, CD3D, B2M, CIITA, CD247, HLA-A, HLA-B, HLA-C, DCK, CD52, FKBP1A, NLRC5, RFXANK, RFX5, RFXAP, NR3C1, CD274, HAVCR2, LAG3, PDCD1, PD-L2, HCF2, PAI, TFPI, PLAT, PLAU, PLG, RPOZ, F7, F8, F9, F2, F5, F7, F10, F11, F12, F13A1, F13B, STAT1, FOXP3, IL2RG, DCLRE1C, ICOS, MHC2TA, GALNS, HGSNAT, ARSB, RFXAP, CD20, CD81, TNFRSF13B, SEC23B, PKLR, IFNG, SPTB, SPTA, SLC4A1, EPO, EPB42, CSF2 CSF3, VFW, SERPINCA1, CTLA4, CEACAM (e.g., CEACAM-1, CEACAM-3 and/or CEACAM-5), VISTA, BTLA, TIGIT, LAIR1, CD160, 2B4, CD80, CD86, B7-H3 (CD113), B7-H4 (VTCNl), HVEM (TNFRSF14 or CD107), KIR, A2aR, MHC class I, MHC class II, GAL9, adenosine, and TGF beta, PTPN11, and combinations thereof. In embodiments, the target sequence within the genomic nucleic acid sequence at Chrl 1:5,250,094-5,250,237, – strand, hg38; Chrl 1:5,255,022-5,255,164, – strand, hg38; nondeletional HFPH region; Chrl 1:5,249,833 to Chrl 1:5,250,237, – strand, hg38; Chrl 1:5,254,738 to Chrl 1:5,255, 164, – strand, hg38; Chrl 1: 5,249,833-5,249,927, – strand, hg3;

Chrl 1: 5,254,738-5,254,851, – strand, hg38; Chrl 1:5,250,139-5,250,237, – strand, hg38.

In embodiments, the disease is associated with high cholesterol, and regulation of cholesterol is provided, in some embodiments, regulation is effected by modification in the target PCSK9. Other diseases in which PCSK9 can be implicated, and thus would be a target for the systems and methods described herein include Abetaiipoproteinemia, Adenoma, Arteriosclerosis, Atherosclerosis, Cardiovascular Diseases, Cholelithiasis, Coronary Arteriosclerosis, Coronary heart disease, Non-Insulin-Dependent Diabetes Meliitus, Hypercholesterolemia, Familial Hypercholesterolemia, Hyperinsuiinism, Hyperlipidemia, Familial Combined Hyperlipidemia, Hypobetalipoproteinemias, Chronic Kidney Failure, Liver diseases, Liver neoplasms, melanoma, Myocardial Infarction, Narcolepsy, Neoplasm Metastasis, Nephroblastoma, Obesity, Peritonitis, Pseudoxanthoma Elasticum, Cerebrovascular accident, Vascular Diseases, Xanthomatosis, Peripheral Vascular Diseases, Myocardial Ischemia, Dyslipidemias, Impaired glucose tolerance, Xanthoma, Polygenic hypercholesterolemia, Secondary malignant neoplasm of liver, Dementia, Overweight, Hepatitis C, Chronic, Carotid Atherosclerosis, Hyperlipoproteinemia Type Ha, Intracranial Atherosclerosis, Ischemic stroke, Acute Coronary Syndrome, Aortic calcification, Cardiovascular morbidity, Hyperlipoproteinemia Type lib, Peripheral Arterial Diseases, Familial Hyperaldosteronism Type II, Familial hypobetalipoproteinemia, Autosomal Recessive Hypercholesterolemia, Autosomal Dominant Hypercholesterolemia 3, Coronary Artery Disease, Liver carcinoma, Ischemic Cerebrovascular Accident, and Arteriosclerotic cardiovascular disease NOS. In embodiments, the treatment can be targeted to the liver, the primary location of activity of PCSK9.

In embodiments, the disease or disorder is Hyper IGM syndrome or a disorder characterized by defective CD40 signaling. In certain embodiments, the insertion of CD40L exons are used to restore proper CD40 signaling and B cell class switch recombination. In particular embodiments, the target is CD40 ligand (CD40L)-edited at one or more of exons 2-5 of the CD40L gene, in cells, e.g., T cells or hematopoietic stem cells (HSCs).

In embodiments, the disease is merosin-deficient congenital muscular dystrophy (mdcmd) and other laminin, alpha 2 (lama2) gene related conditions or disorders. The therapy can be targeted to the muscle, for example, skeletal muscle, smooth muscle, and/or cardiac muscle. In certain embodiments, the target is Laminin, Alpha 2 (LAMA2) which may also be referred to as Laminin-12 Subunit Alpha, Laminin-2 Subunit Alpha, Laminin-4 Subunit Alpha 3, Merosin Heavy Chain, Laminin M Chain, LAMM, Congenital Muscular Dystrophy and Merosin. LAMA2 has a cytogenetic location of 6q22.33 and the genomic coordinate are on Chromosome 6 on the forward strand at position 128,883, 141-129,516, 563. In embodiments, the disease treated can be Merosin-Deficient Congenital Muscular Dystrophy (MDCMD), Amyotrophic Lateral Sclerosis, Bladder Neoplasm, Charcot-Marie-Tooth Disease, Colorectal Carcinoma, Contracture, Cyst, Duchenne Muscular Dystrophy, Fatigue, Hyperopia, Renovascular Hypertension, melanoma, Mental Retardation, Myopathy, Muscular Dystrophy, Myopia, Myositis, Neuromuscular Diseases, Peripheral Neuropathy, Refractive Errors, Schizophrenia, Severe mental retardation (I.Q. 20-34), Thyroid Neoplasm, Tobacco Use Disorder, Severe Combined Immunodeficiency, Synovial Cyst, Adenocarcinoma of lung (disorder), Tumor Progression, Strawberry nevus of skin, Muscle degeneration, Microdontia (disorder), Walker-Warburg congenital muscular dystrophy, Chronic Periodontitis, Leukoencephalopathies, Impaired cognition, Fukuyama Type Congenital Muscular Dystrophy, Scleroatonic muscular dystrophy, Eichsfeld type congenital muscular dystrophy, Neuropathy, Muscle eye brain disease, Limb-Muscular Dystrophies, Girdle, Congenital muscular dystrophy (disorder), Muscle fibrosis, cancer recurrence, Drug Resistant Epilepsy, Respiratory Failure, Myxoid cyst, Abnormal breathing, Muscular dystrophy congenital merosin negative, Colorectal Cancer, Congenital Muscular Dystrophy due to Partial LAMA2 Deficiency, and Autosomal Dominant Craniometaphyseal Dysplasia.

In certain embodiments, the target is an AAVS1 (PPPIR12C), an ALB gene, an Angptl3 gene, an ApoC3 gene, an ASGR2 gene, a CCR5 gene, a FIX (F9) gene, a G6PC gene, a Gys2 gene, an HGD gene, a Lp(a) gene, a Pcsk9 gene, a Serpinal gene, a TF gene, and a TTR gene). Assessment of efficiency of HDR/NHEJ mediated knock-in of cDNA into the first exon can utilize cDNA knock-in into "safe harbor" sites such as: single-stranded or double-stranded DNA having homologous arms to one of the following regions, for example: ApoC3 (chr11:116829908-116833071), Angptl3 (chr1:62,597,487-62,606,305), Serpinal (chr14:94376747-94390692), Lp(a) (chr6:160531483-160664259), Pcsk9 (chr1:55,039,475-55,064,852), FIX (chrX:139,530,736-139,563,458), ALB (chr4:73,404,254-73,421,411), TTR (chr1 8:31,591,766-31,599,023), TF (chr3:133,661,997-133,779,005), G6PC (chr17:42,900,796-42,914,432), Gys2 (chr12:21,536,188-21,604,857), AAVS1 (PPP1R12C) (chr19:55,090,912-55,117,599), HGD (chr3:120,628,167-120,682,570), CCR5 (chr3:46,370,854-46,376,206), or ASGR2 (chr17:7,101,322-7,114,310).

In one aspect, the target is superoxide dismutase 1, soluble (SOD1), which can aid in treatment of a disease or disorder associated with the gene. In particular embodiments, the disease or disorder is associated with SOD1, and can be, for example, Adenocarcinoma, Albuminuria, Chronic Alcoholic Intoxication, Alzheimer's Disease, Amnesia, Amyloidosis, Amyotrophic Lateral Sclerosis, Anemia, Autoimmune hemolytic anemia, Sickle Cell Anemia, Anoxia, Anxiety Disorders, Aortic Diseases, Arteriosclerosis, Rheumatoid Arthritis, Asphyxia Neonatorum, Asthma, Atherosclerosis, Autistic Disorder, Autoimmune Diseases, Barrett Esophagus, Behcet Syndrome, Malignant neoplasm of urinary bladder, Brain Neoplasms, Malignant neoplasm of breast, Oral candidiasis, Malignant tumor of colon, Bronchogenic Carcinoma, Non-Small Cell Lung Carcinoma, Squamous cell carcinoma, Transitional Cell Carcinoma, Cardiovascular Diseases, Carotid Artery Thrombosis, Neoplastic Cell Transformation, Cerebral Infarction, Brain Ischemia, Transient Ischemic Attack, Charcot-Marie-Tooth Disease, Cholera, Colitis, Colorectal Carcinoma, Coronary Arteriosclerosis, Coronary heart disease, Infection by *Cryptococcus neoformans*, Deafness, Cessation of life, Deglutition Disorders, Presenile dementia, Depressive disorder, Contact Dermatitis, Diabetes, Diabetes Mellitus, Experimental Diabetes Mellitus, Insulin-Dependent Diabetes Mellitus, Non-Insulin-Dependent Diabetes Mellitus, Diabetic Angiopathies, Diabetic Nephropathy, Diabetic Retinopathy, Down Syndrome, Dwarfism, Edema, Japanese Encephalitis, Toxic Epidermal Necrolysis, Temporal Lobe Epilepsy, Exanthema, Muscular fasciculation, Alcoholic Fatty Liver, Fetal Growth Retardation, Fibromyalgia, Fibrosarcoma, Fragile X Syndrome, Giardiasis, Glioblastoma, Glioma, Headache, Partial Hearing Loss, Cardiac Arrest, Heart failure, Atrial Septal Defects, Helminthiasis, Hemochromatosis, Hemolysis (disorder), Chronic Hepatitis, HIV Infections, Huntington Disease, Hypercholesterolemia, Hyperglycemia, Hyperplasia, Hypertensive disease, Hyperthyroidism, Hypopituitarism, Hypoproteinemia, Hypotension, natural Hypothermia, Hypothyroidism, Immunologic Deficiency Syndromes, Immune System Diseases, Inflammation, Inflammatory Bowel Diseases, Influenza, Intestinal Diseases, Ischemia, Kearns-Sayre syndrome, Keratoconus, Kidney Calculi, Kidney Diseases, Acute Kidney Failure, Chronic Kidney Failure, Polycystic Kidney Diseases, leukemia, Myeloid Leukemia, Acute Promyelocytic Leukemia, Liver Cirrhosis, Liver diseases, Liver neoplasms, Locked-In Syndrome, Chronic Obstructive Airway Disease, Lung Neoplasms, Systemic Lupus Erythematosus, Non-Hodgkin Lymphoma, Machado-Joseph Disease, Malaria, Malignant neoplasm of stomach, Animal Mammary Neoplasms, Marfan Syndrome, Meningomyelocele, Mental Retardation, Mitral Valve Stenosis, Acquired Dental Fluorosis, Movement Disorders, Multiple Sclerosis, Muscle Rigidity, Muscle Spasticity, Muscular Atrophy, Spinal Muscular Atrophy, Myopathy, Mycoses, Myocardial Infarction, Myocardial Reperfusion Injury, Necrosis, Nephrosis, Nephrotic Syndrome, Nerve Degeneration, nervous system disorder, Neuralgia, Neuroblastoma, Neuroma, Neuromuscular Diseases, Obesity, Occupational Diseases, Ocular Hypertension, Oligospermia, Degenerative polyarthritis, Osteoporosis, Ovarian Carcinoma, Pain, Pancreatitis, Papillon-Lefevre Disease, Paresis, Parkinson Disease, Phenylketonurias, Pituitary Diseases, Pre-Eclampsia, Prostatic Neoplasms, Protein Deficiency, Proteinuria, Psoriasis, Pulmonary Fibrosis, Renal Artery Obstruction, Reperfusion Injury, Retinal Degeneration, Retinal Diseases, Retinoblastoma, Schistosomiasis, Schistosomiasis mansoni, Schizophrenia, Scrapie, Seizures, Age-related cataract, Compression of spinal cord, Cerebrovascular accident, Subarachnoid Hemorrhage, Progressive supranuclear palsy, Tetanus, Trisomy, Turner Syndrome, Unipolar Depression, Urticaria, Vitiligo, Vocal Cord Paralysis, Intestinal Volvulus, Weight Gain, HMN (Hereditary Motor Neuropathy) Proximal Type I, Holoprosencephaly, Motor Neuron Disease, Neurofibrillary degeneration (morphologic abnormality), Burning sensation, Apathy, Mood swings, Synovial Cyst, Cataract, Migraine Disorders, Sciatic Neuropathy, Sensory neuropathy, Atrophic condition of skin, Muscle Weakness, Esophageal carcinoma, Lingual-Facial-Buccal Dyskinesia, Idiopathic pulmonary hypertension, Lateral Sclerosis, Migraine with Aura, Mixed Conductive-Sensorineural Hearing Loss, Iron deficiency anemia, Malnutrition, Prion Diseases, Mitochondrial Myopathies, MELAS Syndrome, Chronic progressive external ophthalmoplegia, General Paralysis, Premature aging syndrome, Fibrillation, Psychiatric symptom, Memory impairment, Muscle degeneration, Neurologic Symptoms, Gastric hemorrhage, Pancreatic carcinoma, Pick Disease of the Brain, Liver Fibrosis, Malignant neoplasm of lung, Age related macular degeneration, Parkinsonian Disorders, Disease Progression, Hypocupremia, Cytochrome-c Oxidase Deficiency, Essential Tremor, Familial Motor Neuron Disease, Lower Motor Neuron Disease, Degenerative myelopathy, Diabetic Polyneuropathies, Liver and Intrahepatic Biliary Tract Carcinoma, Persian Gulf Syndrome, Senile Plaques, Atrophic, Frontotemporal dementia, Semantic Dementia, Common Migraine, Impaired cognition, Malignant neoplasm of liver, Malignant neoplasm of pancreas, Malignant neoplasm of prostate, Pure Autonomic Failure, Motor symptoms, Spastic, Dementia, Neurodegenerative Disorders, Chronic Hepatitis C, Guam Form Amyotrophic Lateral Sclerosis, Stiff limbs, Multisystem disorder, Loss of scalp hair, Prostate carcinoma, Hepatopulmonary Syndrome, Hashimoto Disease, Progressive Neoplastic Disease, Breast Carcinoma, Terminal illness, Carcinoma of lung, Tardive Dyskinesia, Secondary malignant neoplasm of lymph node, Colon Carcinoma, Stomach Carcinoma, Central neuroblastoma, Dissecting aneurysm of the thoracic aorta, Diabetic macular edema, Microalbuminuria, Middle Cerebral Artery Occlusion, Middle Cerebral Artery Infarction, Upper motor neuron signs, Frontotemporal Lobar Degeneration, Memory Loss, Classical phenylketonuria, CADASIL Syndrome, Neurologic Gait Disorders, Spinocerebellar Ataxia Type 2, Spinal Cord Ischemia, Lewy Body Disease, Muscular Atrophy, Spinobulbar, Chromosome 21 monosomy, Thrombocytosis, Spots on skin, Drug-Induced Liver Injury, Hereditary Leber Optic Atrophy, Cerebral Ischemia, ovarian neoplasm, Tauopathies, Macroangiopathy, Persistent pulmonary hypertension, Malignant neoplasm of ovary, Myxoid cyst, Drusen, Sarcoma, Weight decreased, Major Depressive Disorder, Mild cognitive disorder, Degenerative disorder, Partial Trisomy, Cardiovascular morbidity, hearing impairment, Cognitive changes, Ureteral Calculi, Mammary Neoplasms, Colorectal Cancer, Chronic Kidney Diseases, Minimal Change Nephrotic Syndrome, Non-Neoplastic Disorder, X-Linked Bulbo-Spinal Atrophy, Mammographic Density, Normal Tension Glaucoma Susceptibility To Finding), Vitiligo-Associated Multiple Autoimmune Disease Susceptibility 1 (Finding), Amyotrophic Lateral Sclerosis And/Or Frontotemporal Dementia 1, Amyotrophic Lateral Sclerosis 1, Sporadic Amyotrophic Lateral Sclerosis, monomelic Amyotrophy, Coronary Artery Disease, Transformed migraine, Regurgitation, Urothelial Carcinoma, Motor disturbances, Liver carcinoma, Protein Misfolding Disorders, TDP-43 Proteinopathies, Promyelocytic leukemia, Weight Gain Adverse Event, Mitochondrial cytopathy, Idiopathic pulmonary arterial hypertension, Progressive cGVHD, Infection, GRN-related frontotemporal dementia, Mitochondrial pathology, and Hearing Loss.

In particular embodiments, the disease is associated with the gene ATXN1, ATXN2, or ATXN3, which may be targeted for treatment. In some embodiments, the CAG repeat region located in exon 8 of ATXN1, exon 1 of ATXN2, or exon 10 of the ATXN3 is targeted. In embodiments, the disease is spinocerebellar ataxia 3 (sca3), sca1, or sca2 and other related disorders, such as Congenital Abnormality, Alzheimer's Disease, Amyotrophic Lateral Sclerosis, Ataxia, Ataxia Telangiectasia, Cerebellar Ataxia, Cerebellar Diseases, Chorea, Cleft Palate, Cystic Fibrosis, Mental Depression, Depressive disorder, Dystonia, Esophageal Neoplasms, Exotropia, Cardiac Arrest, Huntington Disease, Machado-Joseph Disease, Movement Disorders, Muscular Dystrophy, Myotonic Dystrophy, Narcolepsy, Nerve Degeneration, Neuroblastoma, Parkinson Disease, Peripheral Neuropathy, Restless Legs Syndrome, Retinal Degeneration, Retinitis Pigmentosa, Schizophrenia, Shy-Drager Syndrome, Sleep disturbances, Hereditary Spastic Paraplegia, Thromboembolism, Stiff-Person Syndrome, Spinocerebellar Ataxia, Esophageal carcinoma, Polyneuropathy, Effects of heat, Muscle twitch, Extrapyramidal sign, Ataxic, Neurologic Symptoms, Cerebral atrophy, Parkinsonian Disorders, Protein S Deficiency, Cerebellar degeneration, Familial Amyloid Neuropathy Portuguese Type, Spastic syndrome, Vertical Nystagmus, Nystagmus End-Position, Antithrombin III Deficiency, Atrophic, Complicated hereditary spastic paraplegia, Multiple System Atrophy, Pallidoluysian degeneration, Dystonia Disorders, Pure Autonomic Failure, Thrombophilia, Protein C, Deficiency, Congenital Myotonic Dystrophy, Motor symptoms, Neuropathy, Neurodegenerative Disorders, Malignant neoplasm of esophagus, Visual disturbance, Activated Protein C Resistance, Terminal illness, Myokymia, Central neuroblastoma, Dyssomnias, Appendicular Ataxia, Narcolepsy-Cataplexy Syndrome, Machado-Joseph Disease Type I, Machado-Joseph Disease Type II, Machado-Joseph Disease Type III, Dentatorubral-Pallidoluysian Atrophy, Gait Ataxia, Spinocerebellar Ataxia Type 1, Spinocerebellar Ataxia Type 2, Spinocerebellar Ataxia Type 6 (disorder), Spinocerebellar Ataxia Type 7, Muscular Spinobulbar Atrophy, Genomic Instability, Episodic ataxia type 2 (disorder), Bulbo-Spinal Atrophy X-Linked, Fragile X Tremor/Ataxia Syndrome, Thrombophilia Due to Activated Protein C Resistance (Disorder), Amyotrophic Lateral Sclerosis 1, Neuronal Intranuclear Inclusion Disease, Hereditary Antithrombin Iii Deficiency, and Late-Onset Parkinson Disease.

In embodiments, the disease is associated with expression of a tumor antigen-cancer or non-cancer related indication, for example acute lymphoid leukemia, diffuse large B cell lymphoma, follicular lymphoma, chronic lymphocytic leukemia, Hodgkin lymphoma, non-Hodgkin lymphoma. In embodiments, the target can be TET2 intron, a TET2 intron-exon junction, a sequence within a genomic region of chr4.

In embodiments, neurodegenerative diseases can be treated. In particular embodiments, the target is Synuclein, Alpha (SNCA). In certain embodiments, the disorder treated is a pain related disorder, including congenital pain insensitivity, Compressive Neuropathies, Paroxysmal Extreme Pain Disorder, High grade atrioventricular block, Small Fiber Neuropathy, and Familial Episodic Pain Syndrome 2. In certain embodiments, the target is Sodium Channel, Voltage Gated, Type X Alpha Subunit (SCNIOA).

In certain embodiments, hematopoietic stem cells and progenitor stem cells are edited, including knock-ins. In particular embodiments, the knock-in is for treatment of lysosomal storage diseases, glycogen storage diseases, mucopolysaccharoidoses, or any disease in which the secretion of a protein will ameliorate the disease. In one embodiment, the disease is sickle cell disease (SCD). In another embodiment, the disease is β-thalessemia.

In certain embodiments, the T cell or NK cell is used for cancer treatment and may include T cells comprising the recombinant receptor (e.g. CAR) and one or more phenotypic markers selected from CCR7+, 4-1BB+ (CD137+), TIM3+, CD27+, CD62L+, CD127+, CD45RA+, CD45RO−, t-betl'w, IL-7Ra+, CD95+, IL-2RP+, CXCR3+ or LFA-1+. In certain embodiments the editing of a T cell for caner immunotherapy comprises altering one or more T-cell expressed gene, e.g., one or more of FAS, BID, CTLA4, PDCD1, CBLB, PTPN6, B2M, TRAC and TRBC gene. In some embodiments, editing includes alterations introduced into, or proximate to, the CBLB target sites to reduce CBLB gene expression in T cells for treatment of proliferative diseases and may include larger insertions or deletions at one or more CBLB target sites. T cell editing of TGFBR2 target sequence can be, for example, located in exon 3, 4, or 5 of the TGFBR2 gene and utilized for cancers and lymphoma treatment.

Cells for transplantation can be edited and may include allele-specific modification of one or more immunogenicity genes (e.g., an HLA gene) of a cell, e.g., HLA-A, HLA-B, HLA-C, HLA-DRB1, HLA-DRB3/4/5, HLA-DQ, and HLA-DP MiHAs, and any other MHC Class I or Class II genes or loci, which may include delivery of one or more matched recipient HLA alleles into the original position(s) where the one or more mismatched donor HLA alleles are located, and may include inserting one or more matched recipient HLA alleles into a "safe harbor" locus. In an embodiment, the method further includes introducing a chemotherapy resistance gene for in vivo selection in a gene.

Methods and systems can target Dystrophia Myotonica-Protein Kinase (DMPK) for editing, in particular embodiments, the target is the CTG trinucleotide repeat in the 3' untranslated region (UTR) of the DMPK gene. Disorders or diseases associated with DMPK include Atherosclerosis, Azoospermia, Hypertrophic Cardiomyopathy, Celiac Disease, Congenital chromosomal disease, Diabetes Mellitus, Focal glomerulosclerosis, Huntington Disease, Hypogonadism, Muscular Atrophy, Myopathy, Muscular Dystrophy, Myotonia, Myotonic Dystrophy, Neuromuscular Diseases, Optic Atrophy, Paresis, Schizophrenia, Cataract, Spinocerebellar Ataxia, Muscle Weakness, Adrenoleukodystrophy, Centronuclear myopathy, Interstitial fibrosis, myotonic muscular dystrophy, Abnormal mental state, X-linked Charcot-Marie-Tooth disease 1, Congenital Myotonic Dystrophy, Bilateral cataracts (disorder), Congenital Fiber Type Disproportion, Myotonic Disorders, Multisystem disorder, 3-Methylglutaconic aciduria type 3, cardiac event, Cardiogenic Syncope, Congenital Structural Myopathy, Mental handicap, Adrenomyeloneuropathy, Dystrophia myotonica 2, and Intellectual Disability.

In embodiments, the disease is an inborn error of metabolism. The disease may be selected from Disorders of Carbohydrate Metabolism (glycogen storage disease, G6PD deficiency), Disorders of Amino Acid Metabolism (phenylketonuria, maple syrup urine disease, glutaric acidemia type 1), Urea Cycle Disorder or Urea Cycle Defects (carbamoyl phosphate synthease I deficiency), Disorders of Organic Acid Metabolism (alkaptonuria, 2-hydroxyglutaric acidurias), Disorders of Fatty Acid Oxidation/Mitochondrial Metabolism (Medium-chain acyl-coenzyme A dehydrogenase deficiency), Disorders of Porphyrin metabolism (acute intermittent porphyria), Disorders of Purine/Pyrimidine Metabolism (Lesch-Nynan syndrome), Disorders of Steroid Metabolism (lipoid congenital adrenal hyperplasia, congenital adrenal hyperplasia), Disorders of Mitochondrial Function (Kearns-Sayre syndrome), Disorders of Peroxisomal function (Zellweger syndrome), or Lysosomal Storage Disorders (Gaucher's disease, Niemann-Pick disease).

In embodiments, the target can comprise Recombination Activating Gene 1 (RAG1), BCL11 A, PCSK9, laminin, alpha 2 (lama2), ATXN3, alanine-glyoxylate aminotransferase (AGXT), collagen type vii alpha 1 chain (COL7a1), spinocerebellar ataxia type 1 protein (ATXN1), Angiopoietin-like 3 (ANGPTL3), Frataxin (FXN), Superoxidase Dismutase 1, soluble (SOD1), Synuclein, Alpha (SNCA), Sodium Channel, Voltage Gated, Type X Alpha Subunit (SCN10A), Spinocerebellar Ataxia Type 2 Protein (ATXN2), Dystrophia Myotonica-Protein Kinase (DMPK), beta globin locus on chromosome 11, acyl-coenzyme A dehydrogenase for medium chain fatty acids (ACADM), long-chain 3-hydroxyl-coenzyme A dehydrogenase for long chain fatty acids (HADHA), acyl-coenzyme A dehydrogenase for very long-chain fatty acids (ACADVL), Apolipoprotein C3 (APOCIII), Transthyretin (TTR), Angiopoietin-like 4 (ANGPTL4), Sodium Voltage-Gated Channel Alpha Subunit 9 (SCN9A), Interleukin-7 receptor (IL7R), glucose-6-phosphatase, catalytic (G6PC), haemochromatosis (HFE), SERPINA1, C90RF72, β-globin, dystrophin, γ-globin.

In certain embodiments, the disease or disorder is associated with Apolipoprotein C3 (APOCIII), which can be targeted for editing. In embodiments, the disease or disorder may be Dyslipidemias, Hyperalphalipoproteinemia Type 2, Lupus Nephritis, Wilms Tumor 5, Morbid obesity and spermatogenic, Glaucoma, Diabetic Retinopathy, Arthrogryposis renal dysfunction cholestasis syndrome, Cognition Disorders, Altered response to myocardial infarction, Glucose Intolerance, Positive regulation of triglyceride biosynthetic process, Renal Insufficiency, Chronic, Hyperlipidemias, Chronic Kidney Failure, Apolipoprotein C-III Deficiency, Coronary Disease, Neonatal Diabetes Mellitus, Neonatal, with Congenital Hypothyroidism, Hypercholesterolemia Autosomal Dominant 3, Hyperlipoproteinemia Type III, Hyperthyroidism, Coronary Artery Disease, Renal Artery Obstruction, Metabolic Syndrome X, Hyperlipidemia, Familial Combined, Insulin Resistance, Transient infantile hypertriglyceridemia, Diabetic Nephropathies, Diabetes Mellitus (Type 1), Nephrotic Syndrome Type 5 with or without ocular abnormalities, and Hemorrhagic Fever with renal syndrome.

In certain embodiments, the target is Angiopoietin-like 4 (ANGPTL4). Diseases or disorders associated with ANGPTL4 that can be treated include ANGPTL4 is associated with dyslipidemias, low plasma triglyceride levels, regulator of angiogenesis and modulate tumorigenesis, and severe diabetic retinopathy. both proliferative diabetic retinopathy and non-proliferative diabetic retinopathy.

In embodiments, editing can be used for the treatment of fatty acid disorders. In certain embodiments, the target is one or more of ACADM, HADHA, ACADVL. In embodiments, the targeted edit is the activity of a gene in a cell selected from the acyl-coenzyme A dehydrogenase for medium chain fatty acids (ACADM) gene, the long-chain 3-hydroxyl-coenzyme A dehydrogenase for long chain fatty acids (HADHA) gene, and the acyl-coenzyme A dehydrogenase for very long-chain fatty acids (ACADVL) gene. In one aspect, the disease is medium chain acyl-coenzyme A dehydrogenase deficiency (MCADD), long-chain 3-hydroxyl-coenzyme A dehydrogenase deficiency (LCHADD), and/or very long-chain acyl-coenzyme A dehydrogenase deficiency (VLCADD).

Immune Orthogonal Orthologs

In some embodiments, when CRISPR enzymes need to be expressed or administered in a subject, immunogenicity of CRISPR enzymes may be reduced by sequentially expressing or administering immune orthogonal orthologs of the CRISPR enzymes to the subject. As used herein, the term "immune orthogonal orthologs" refer to orthologous proteins that have similar or substantially the same function or activity, but have no or low cross-reactivity with the immune response generated by one another. In some embodiments, sequential expression or administration of such orthologs elicits low or no secondary immune response. The immune orthogonal orthologs can avoid being neutralized by antibodies (e.g., existing antibodies in the host before the orthologs are expressed or administered). Cells expressing the orthologs can avoid being cleared by the host's immune system (e.g., by activated CTLs). In some examples, CRISPR enzyme orthologs from different species may be immune orthogonal orthologs.

Immune orthogonal orthologs may be identified by analyzing the sequences, structures, and/or immunogenicity of a set of candidates orthologs. In an example method, a set of immune orthogonal orthologs may be identified by a) comparing the sequences of a set of candidate orthologs (e.g., orthologs from different species) to identify a subset of candidates that have low or no sequence similarity; b) assessing immune overlap among the members of the subset of candidates to identify candidates that have no or low immune overlap. In some cases, immune overlap among candidates may be assessed by determining the binding (e.g., affinity) between a candidate ortholog and MHC (e.g., MHC type I and/or MHC II) of the host. Alternatively or additionally, immune overlap among candidates may be assessed by determining B-cell epitopes for the candidate orthologs. In one example, immune orthogonal orthologs may be identified using the method described in Moreno A M et al., BioRxiv, published online Jan. 10, 2018, doi: doi.org/10.1101/245985.

Patient-Specific Screening Methods

A nucleic acid-targeting system that targets RNA can be used to screen patients or patient samples for the presence of particular RNA.

Transcript Detection Methods

The effector proteins and systems of the invention are useful for specific detection of RNAs in a cell or other sample. In the presence of an RNA target of interest, guide-dependent CRISPR-Cas nuclease activity may be accompanied by non-specific RNAse activity against collateral targets. To take advantage of the RNase activity, all that is needed is a reporter substrate that can be detectably cleaved. For example, a reporter molecule can comprise RNA, tagged with a fluorescent reporter molecule (fluor) on one end and a quencher on the other. In the absence of CRISPR-Cas RNase activity, the physical proximity of the quencher dampens fluorescence from the fluor to low levels. When CRISPR-Cas target specific cleavage is activated by the presence of an RNA target-of-interest and suitable guide RNA, the RNA-containing reporter molecule is non-specifically cleaved and the fluor and quencher are spatially separated. This causes the fluor to emit a detectable signal when excited by light of the appropriate wavelength. In one exemplary assay method, CRISPR-Cas effector, target-of-interest-specific guide RNA, and reporter molecule are added to a cellular sample. An increase in fluorescence indicates the presence of the RNA target-of-interest. In another exemplary method, a detection array is provided. Each location of the array is provided with CRISPR-Cas effector, reporter molecule, and a target-of-interest-specific guide RNA. Depending on the assay to be performed, the target-of-interest-specific guide RNAs at each location of the array can be the same, different, or a combination thereof. Different target-of-interest-specific guide RNAs might be provided, for example when it is desired to test for one or more targets in a single source sample. The same target-of-interest-specific guide RNA might be provided at each location, for example when it is desired to test multiple samples for the same target.

In certain embodiments, CRISPR-Cas is provided or expressed in an in vitro system or in a cell, transiently or stably, and targeted or triggered to non-specifically cleave cellular nucleic acids. In one embodiment, CRISPR-Cas is engineered to knock down ssDNA, for example viral ssDNA. In another embodiment, CRISPR-Cas is engineered to knock down RNA. The system can be devised such that the knockdown is dependent on a target DNA present in the cell or in vitro system, or triggered by the addition of a target nucleic acid to the system or cell.

In an embodiment, the CRISPR-Cas system is engineered to non-specifically cleave RNA in a subset of cells distinguishable by the presence of an aberrant DNA sequence, for instance where cleavage of the aberrant DNA might be incomplete or ineffectual. In one non-limiting example, a DNA translocation that is present in a cancer cell and drives cell transformation is targeted. Whereas a subpopulation of cells that undergoes chromosomal DNA and repair may survive, non-specific collateral ribonuclease activity advantageously leads to cell death of potential survivors.

Additional Aspects of Application

The invention has a broad spectrum of applications in, e.g., gene therapy, drug screening, disease diagnosis, and prognosis.

The terms "polynucleotide", "nucleotide", "nucleotide sequence", "nucleic acid" and "oligonucleotide" are used interchangeably. They refer to a polymeric form of nucleotides of any length, either deoxyribonucleotides or ribonucleotides, or analogs thereof. Polynucleotides may have any three dimensional structure, and may perform any function, known or unknown. The following are non-limiting examples of polynucleotides: coding or non-coding regions of a gene or gene fragment, loci (locus) defined from linkage analysis, exons, introns, messenger RNA (mRNA), transfer RNA, ribosomal RNA, short interfering RNA (siRNA), short-hairpin RNA (shRNA), micro-RNA (miRNA), ribozymes, cDNA, recombinant polynucleotides, branched polynucleotides, plasmids, vectors, isolated DNA of any sequence, isolated RNA of any sequence, nucleic acid probes, and primers. The term also encompasses nucleic-acid-like structures with synthetic backbones, see, e.g., Eckstein, 1991; Baserga et al., 1992; Milligan, 1993; WO 97/03211; WO 96/39154; Mata, 1997; Strauss-Soukup, 1997; and Samstag, 1996. A polynucleotide may comprise one or more modified nucleotides, such as methylated nucleotides and nucleotide analogs. If present, modifications to the nucleotide structure may be imparted before or after assembly of the polymer. The sequence of nucleotides may be interrupted by non-nucleotide components. A polynucleotide may be further modified after polymerization, such as by conjugation with a labeling component. As used herein the term "wild type" is a term of the art understood by skilled persons and means the typical form of an organism, strain, gene or characteristic as it occurs in nature as distinguished from mutant or variant forms. A "wild type" can be a base line. As used herein the term "variant" should be taken to mean the exhibition of qualities that have a pattern that deviates from what occurs in nature. The terms "non-naturally occurring" or "engineered" are used interchangeably and indicate the involvement of the hand of man. The terms, when referring to nucleic acid molecules or polypeptides mean that the nucleic acid molecule or the polypeptide is at least substantially free from at least one other component with which they are naturally associated in nature and as found in nature. "Complementarity" refers to the ability of a nucleic acid to form hydrogen bond(s) with another nucleic acid sequence by either traditional Watson-Crick base pairing or other non-traditional types. A percent complementarity indicates the percentage of residues in a nucleic acid molecule which can form hydrogen bonds (e.g., Watson-Crick base pairing) with a second nucleic acid sequence (e.g., 5, 6, 7, 8, 9, 10 out of 10 being 50%, 60%, 70%, 80%, 90%, and 100% complementary). "Perfectly complementary" means that all the contiguous residues of a nucleic acid sequence will hydrogen bond with the same number of contiguous residues in a second nucleic acid sequence. "Substantially complementary" as used herein refers to a degree of complementarity that is at least 60%, 65%, 70%, 75%, 80%, 85%, 90%, 95%, 97%, 98%, 99%, or 100% over a region of 8, 9, 10, 11, 12, 13, 14, 15, 16, 17, 18, 19, 20, 21, 22, 23, 24, 25, 30, 35, 40, 45, 50, or more nucleotides, or refers to two nucleic acids that hybridize under stringent conditions. As used herein, "stringent conditions" for hybridization refer to conditions under which a nucleic acid having complementarity to a target sequence predominantly hybridizes with the target sequence, and substantially does not hybridize to non-target sequences. Stringent conditions are generally sequence-dependent, and vary depending on a number of factors. In general, the longer the sequence, the higher the temperature at which the sequence specifically hybridizes to its target sequence. Non-limiting examples of stringent conditions are described in detail in Tijssen (1993), Laboratory Techniques In Biochemistry And Molecular Biology-Hybridization With Nucleic Acid Probes Part I, Second Chapter "Overview of principles of hybridization and the strategy of nucleic acid probe assay", Elsevier, N.Y. Where reference is made to a polynucleotide sequence, then complementary or partially complementary sequences are also envisaged. These are preferably capable of hybridizing to the reference sequence under highly stringent conditions. Generally, in order to maximize the hybridization rate, relatively low-stringency hybridization conditions are selected: about 20 to 25° C. lower than the thermal melting point ($T_m$). The $T_m$ is the temperature at which 50% of specific target sequence hybridizes to a perfectly complementary probe in solution at a defined ionic strength and pH. Generally, in order to require at least about 85% nucleotide complementarity of hybridized sequences, highly stringent washing conditions are selected to be about 5 to 15° C. lower than the $T_m$. In order to require at least about 70% nucleotide complementarity of hybridized sequences, moderately-stringent washing conditions are selected to be about 15 to 30° C. lower than the $T_m$. Highly permissive (very low stringency) washing conditions may be as low as 50° C. below the $T_m$, allowing a high level of mis-matching between hybridized sequences. Those skilled in the art will recognize that other physical and chemical parameters in the hybridization and wash stages can also be altered to affect the outcome of a detectable hybridization signal from a specific level of homology between target and probe sequences. Preferred highly stringent conditions comprise incubation in 50% formamide, 5×SSC, and 1% SDS at 42° C., or incubation in 5×SSC and 1% SDS at 65° C., with wash in 0.2×SSC and 0.1% SDS at 65° C. "Hybridization" refers to a reaction in which one or more polynucleotides react to form a complex that is stabilized via hydrogen bonding between the bases of the nucleotide residues. The hydrogen bonding may occur by Watson Crick base pairing, Hoogstein binding, or in any other sequence specific manner. The complex may comprise two strands forming a duplex structure, three or more strands forming a multi stranded complex, a single self-hybridizing strand, or any combination of these. A hybridization reaction may constitute a step in a more extensive process, such as the initiation of PCR, or the cleavage of a polynucleotide by an enzyme. A sequence capable of hybridizing with a given sequence is referred to as the "complement" of the given sequence. As used herein, the term "genomic locus" or "locus" (plural loci) is the specific location of a gene or DNA sequence on a chromosome. A "gene" refers to stretches of DNA or RNA that encode a polypeptide or an RNA chain that has functional role to play in an organism and hence is the molecular unit of heredity in living organisms. For the purpose of this invention it may be considered that genes include regions which regulate the production of the gene product, whether or not such regulatory sequences are adjacent to coding and/or transcribed sequences. Accordingly, a gene includes, but is not necessarily limited to, promoter sequences, terminators, translational regulatory sequences such as ribosome binding sites and internal ribosome entry sites, enhancers, silencers, insulators, boundary elements, replication origins, matrix attachment sites and locus control regions. As used herein, "expression of a genomic locus" or "gene expression" is the process by which information from a gene is used in the synthesis of a functional gene product. The products of gene expression are often proteins, but in non-protein coding genes such as rRNA genes or tRNA genes, the product is functional RNA. The process of gene expression is used by all known life—eukaryotes (including multicellular organisms), prokaryotes (bacteria and archaea) and viruses to generate functional products to survive. As used herein "expression" of a gene or nucleic acid encompasses not only cellular gene expression, but also the transcription and translation of nucleic acid(s) in cloning systems and in any other context. As used herein, "expression" also refers to the process by which a polynucleotide is transcribed from a DNA template (such as into and mRNA or other RNA transcript) and/or the process by which a transcribed mRNA is subsequently translated into peptides, polypeptides, or proteins. Transcripts and encoded polypeptides may be collectively referred to as "gene product." If the polynucleotide is derived from genomic DNA, expression may include splicing of the mRNA in a eukaryotic cell. The terms "polypeptide", "peptide" and "protein" are used interchangeably herein to refer to polymers of amino acids of any length. The polymer may be linear or branched, it may comprise modified amino acids, and it may be interrupted by non-amino acids. The terms also encompass an amino acid polymer that has been modified; for example, disulfide bond formation, glycosylation, lipidation, acetylation, phosphorylation, or any other manipulation, such as conjugation with a labeling component. As used herein the term "amino acid" includes natural and/or unnatural or synthetic amino acids, including glycine and both the D or L optical isomers, and amino acid analogs and peptidomimetics. As used herein, the term "domain" or "protein domain" refers to a part of a protein sequence that may exist and function independently of the rest of the protein chain. As described in aspects of the invention, sequence identity is related to sequence homology. Homology comparisons may be conducted by eye, or more usually, with the aid of readily available sequence comparison programs. These commercially available computer programs may calculate percent (%) homology between two or more sequences and may also calculate the sequence identity shared by two or more amino acid or nucleic acid sequences.

As used herein the term "wild type" is a term of the art understood by skilled persons and means the typical form of an organism, strain, gene or characteristic as it occurs in nature as distinguished from mutant or variant forms. A "wild type" can be a base line.

As used herein the term "variant" should be taken to mean the exhibition of qualities that have a pattern that deviates from what occurs in nature. The terms "non-naturally occurring" or "engineered" are used interchangeably and indicate the involvement of the hand of man. The terms, when referring to nucleic acid molecules or polypeptides mean that the nucleic acid molecule or the polypeptide is at least substantially free from at least one other component with which they are naturally associated in nature and as found in nature. In all aspects and embodiments, whether they include these terms or not, it will be understood that, preferably, the may be optional and thus preferably included or not preferably not included. Furthermore, the terms "non-naturally occurring" and "engineered" may be used interchangeably and so can therefore be used alone or in combination and one or other may replace mention of both together. In particular, "engineered" is preferred in place of "non-naturally occurring" or "non-naturally occurring and/or engineered."

Sequence homologies may be generated by any of a number of computer programs known in the art, for example BLAST or FASTA, etc. A suitable computer program for carrying out such an alignment is the GCG Wisconsin Bestfit package (University of Wisconsin, U.S.A; Devereux et al., 1984, Nucleic Acids Research 12:387). Examples of other software than may perform sequence comparisons include, but are not limited to, the BLAST package (see Ausubel et al., 1999 ibid—Chapter 18), FASTA (Atschul et al., 1990, J. Mol. Biol., 403-410) and the GENEWORKS suite of comparison tools. Both BLAST and FASTA are available for offline and online searching (see Ausubel et al., 1999 ibid, pages 7-58 to 7-60). However it is preferred to use the GCG Bestfit program. Percentage (%) sequence homology may be calculated over contiguous sequences, i.e., one sequence is aligned with the other sequence and each amino acid or nucleotide in one sequence is directly compared with the corresponding amino acid or nucleotide in the other sequence, one residue at a time. This is called an "ungapped" alignment. Typically, such ungapped alignments are performed only over a relatively short number of residues. Although this is a very simple and consistent method, it fails to take into consideration that, for example, in an otherwise identical pair of sequences, one insertion or deletion may cause the following amino acid residues to be put out of alignment, thus potentially resulting in a large reduction in % homology when a global alignment is performed. Consequently, most sequence comparison methods are designed to produce optimal alignments that take into consideration possible insertions and deletions without unduly penalizing the overall homology or identity score. This is achieved by inserting "gaps" in the sequence alignment to try to maximize local homology or identity. However, these more complex methods assign "gap penalties" to each gap that occurs in the alignment so that, for the same number of identical amino acids, a sequence alignment with as few gaps as possible-reflecting higher relatedness between the two compared sequences—may achieve a higher score than one with many gaps. "Affinity gap costs" are typically used that charge a relatively high cost for the existence of a gap and a smaller penalty for each subsequent residue in the gap. This is the most commonly used gap scoring system. High gap penalties may, of course, produce optimized alignments with fewer gaps. Most alignment programs allow the gap penalties to be modified. However, it is preferred to use the default values when using such software for sequence comparisons. For example, when using the GCG Wisconsin Bestfit package the default gap penalty for amino acid sequences is −12 for a gap and −4 for each extension. Calculation of maximum % homology therefore first requires the production of an optimal alignment, taking into consideration gap penalties. A suitable computer program for carrying out such an alignment is the GCG Wisconsin Bestfit package (Devereux et al., 1984 *Nuc. Acids Research* 12 p 387). Examples of other software than may perform sequence comparisons include, but are not limited to, the BLAST package (see Ausubel et al., 1999 *Short Protocols in Molecular Biology,* 4$^{th}$ Ed.—Chapter 18), FASTA (Altschul et al., 1990 *J. Mol. Biol.* 403-410) and the GENEWORKS suite of comparison tools. Both BLAST and FASTA are available for offline and online searching (see Ausubel et al., 1999, *Short Protocols in Molecular Biology*, pages 7-58 to 7-60). However, for some applications, it is preferred to use the GCG Bestfit program. A new tool, called BLAST 2 Sequences is also available for comparing protein and nucleotide sequences (see *FEMS Microbiol Lett.* 1999 174 (2): 247-50; *FEMS Microbiol Lett.* 1999 177(1): 187-8 and the website of the National Center for Biotechnology information at the website of the National Institutes for Health). Although the final % homology may be measured in terms of identity, the alignment process itself is typically not based on an all-or-nothing pair comparison. Instead, a scaled similarity score matrix is generally used that assigns scores to each pair-wise comparison based on chemical similarity or evolutionary distance. An example of such a matrix commonly used is the BLOSUM62 matrix—the default matrix for the BLAST suite of programs. GCG Wisconsin programs generally use either the public default values or a custom symbol comparison table, if supplied (see user manual for further details). For some applications, it is preferred to use the public default values for the GCG package, or in the case of other software, the default matrix, such as BLOSUM62. Alternatively, percentage homologies may be calculated using the multiple alignment feature in DNASIS™ (Hitachi Software), based on an algorithm, analogous to CLUSTAL (Higgins D G & Sharp P M (1988), *Gene* 73(1), 237-244). Once the software has produced an optimal alignment, it is possible to calculate % homology, preferably % sequence identity. The software typically does this as part of the sequence comparison and generates a numerical result. The sequences may also have deletions, insertions or substitutions of amino acid residues which produce a silent change and result in a functionally equivalent substance. Deliberate amino acid substitutions may be made on the basis of similarity in amino acid properties (such as polarity, charge, solubility, hydrophobicity, hydrophilicity, and/or the amphipathic nature of the residues) and it is therefore useful to group amino acids together in functional groups. Amino acids may be grouped together based on the properties of their side chains alone. However, it is more useful to include mutation data as well. The sets of amino acids thus derived are likely to be conserved for structural reasons. These sets may be described in the form of a Venn diagram (Livingstone C. D. and Barton G. J. (1993) "Protein sequence alignments: a strategy for the hierarchical analysis of residue conservation" *Comput. Appl. Biosci.* 9: 745-756) (Taylor W. R. (1986) "The classification of amino acid conservation" *J. Theor. Biol.* 119; 205-218). Conservative may be made, for example according to Table 7 which describes a generally accepted Venn diagram grouping of amino acids.

The terms "subject," "individual," and "patient" are used interchangeably herein to refer to a vertebrate, preferably a mammal, more preferably a human. Mammals include, but are not limited to, murines, simians, humans, farm animals, sport animals, and pets. Tissues, cells and their progeny of a biological entity obtained in vivo or cultured in vitro are also encompassed.

The terms "therapeutic agent", "therapeutic capable agent" or "treatment agent" are used interchangeably and refer to a molecule or compound that confers some beneficial effect upon administration to a subject. The beneficial effect includes enablement of diagnostic determinations; amelioration of a disease, symptom, disorder, or pathological condition; reducing or preventing the onset of a disease, symptom, disorder or condition; and generally counteracting a disease, symptom, disorder or pathological condition. As used herein, "treatment" or "treating," or "palliating" or "ameliorating" are used interchangeably. These terms refer to an approach for obtaining beneficial or desired results including but not limited to a therapeutic benefit and/or a prophylactic benefit. By therapeutic benefit is meant any therapeutically relevant improvement in or effect on one or more diseases, conditions, or symptoms under treatment. For prophylactic benefit, the compositions may be administered to a subject at risk of developing a particular disease, condition, or symptom, or to a subject reporting one or more of the physiological symptoms of a disease, even though the disease, condition, or symptom may not have yet been manifested. The term "effective amount" or "therapeutically effective amount" refers to the amount of an agent that is sufficient to effect beneficial or desired results. The therapeutically effective amount may vary depending upon one or more of: the subject and disease condition being treated, the weight and age of the subject, the severity of the disease condition, the manner of administration and the like, which can readily be determined by one of ordinary skill in the art. The term also applies to a dose that will provide an image for detection by any one of the imaging methods described herein. The specific dose may vary depending on one or more of: the particular agent chosen, the dosing regimen to be followed, whether it is administered in combination with other compounds, timing of administration, the tissue to be imaged, and the physical delivery system in which it is carried.

The practice of the present invention employs, unless otherwise indicated, conventional techniques of immunology, biochemistry, chemistry, molecular biology, microbiology, cell biology, genomics and recombinant DNA, which are within the skill of the art. See Sambrook, Fritsch and Maniatis, MOLECULAR CLONING: A LABORATORY MANUAL, 2nd edition (1989); CURRENT PROTOCOLS IN MOLECULAR BIOLOGY (F. M. Ausubel, et al. eds., (1987)); the series METHODS IN ENZYMOLOGY (Academic Press, Inc.): PCR 2: A PRACTICAL APPROACH (M. J. MacPherson, B. D. Hames and G. R. Taylor eds. (1995)), Harlow and Lane, eds. (1988) ANTIBODIES, A LABORATORY MANUAL, and ANIMAL CELL CULTURE (R. I. Freshney, ed. (1987)). Several aspects of the invention relate to vector systems comprising one or more vectors, or vectors as such. Vectors can be designed for expression of CRISPR transcripts (e.g. nucleic acid transcripts, proteins, or enzymes) in prokaryotic or eukaryotic cells. For example, CRISPR transcripts can be expressed in bacterial cells such as *Escherichia coli*, insect cells (using baculovirus expression vectors), yeast cells, or mammalian cells. Suitable host cells are discussed further in Goeddel, GENE EXPRESSION TECHNOLOGY: METHODS IN ENZYMOLOGY 185, Academic Press, San Diego, Calif. (1990). Alternatively, the recombinant expression vector can be transcribed and translated in vitro, for example using T7 promoter regulatory sequences and T7 polymerase. Embodiments of the invention include sequences (both polynucleotide or polypeptide) which may comprise homologous substitution (substitution and replacement are both used herein to mean the interchange of an existing amino acid residue or nucleotide, with an alternative residue or nucleotide) that may occur i.e., like-for-like substitution in the case of amino acids such as basic for basic, acidic for acidic, polar for polar, etc. Non-homologous substitution may also occur i.e., from one class of residue to another or alternatively involving the inclusion of unnatural amino acids such as ornithine (hereinafter referred to as Z), diaminobutyric acid ornithine (hereinafter referred to as B), norleucine ornithine (hereinafter referred to as O), pyriylalanine, thienylalanine, naphthylalanine and phenylglycine. Variant amino acid sequences may include suitable spacer groups that may be inserted between any two amino acid residues of the sequence including alkyl groups such as methyl, ethyl or propyl groups in addition to amino acid spacers such as glycine or β-alanine residues. A further form of variation, which involves the presence of one or more amino acid residues in peptoid form, may be well understood by those skilled in the art. For the avoidance of doubt, "the peptoid form" is used to refer to variant amino acid residues wherein the α-carbon substituent group is on the residue's nitrogen atom rather than the α-carbon. Processes for preparing peptides in the peptoid form are known in the art, for example Simon R J et al., PNAS (1992) 89(20), 9367-9371 and Horwell D C, Trends Biotechnol. (1995) 13(4), 132-134. Homology modelling: Corresponding residues in other CRISPR-Cas orthologs can be identified by the methods of Zhang et al., 2012 (Nature; 490(7421): 556-60) and Chen et al., 2015 (PLoS Comput Biol; 11(5): e1004248)—a computational protein-protein interaction (PPI) method to predict interactions mediated by domain-motif interfaces. PrePPI (Predicting PPI), a structure based PPI prediction method, combines structural evidence with non-structural evidence using a Bayesian statistical framework. The method involves taking a pair a query proteins and using structural alignment to identify structural representatives that correspond to either their experimentally determined structures or homology models. Structural alignment is further used to identify both close and remote structural neighbors by considering global and local geometric relationships. Whenever two neighbors of the structural representatives form a complex reported in the Protein Data Bank, this defines a template for modelling the interaction between the two query proteins. Models of the complex are created by superimposing the representative structures on their corresponding structural neighbor in the template. This approach is further described in Dey et al., 2013 (Prot Sci; 22: 359-66).

For purpose of this invention, amplification means any method employing a primer and a polymerase capable of replicating a target sequence with reasonable fidelity. Amplification may be carried out by natural or recombinant DNA polymerases such as TaqGold™, T7 DNA polymerase, Klenow fragment of *E. coli* DNA polymerase, and reverse transcriptase. A preferred amplification method is PCR. In certain aspects the invention involves vectors. A used herein, a "vector" is a tool that allows or facilitates the transfer of an entity from one environment to another. It is a replicon, such as a plasmid, phage, or cosmid, into which another DNA segment may be inserted so as to bring about the replication of the inserted segment. Generally, a vector is capable of replication when associated with the proper control elements. In general, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g., circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g., retroviruses, replication defective retroviruses, adenoviruses, replication defective adenoviruses, and adeno-associated viruses (AAVs)). Viral vectors also include polynucleotides carried by a virus for transfection into a host cell. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Common expression vectors of utility in recombinant DNA techniques are often in the form of plasmids. Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g., in an in vitro transcription/translation system or in a host cell when the vector is introduced into the host cell). With regards to recombination and cloning methods, mention is made of U.S. patent application Ser. No. 10/815,730, published Sep. 2, 2004 as US 2004-0171156 A1, the contents of which are herein incorporated by reference in their entirety. Aspects of the invention relate to bicistronic vectors for guide RNA and wild type, modified or mutated CRISPR effector proteins/enzymes (e.g. Cas13 effector proteins). Bicistronic expression vectors guide RNA and wild type, modified or mutated CRISPR effector proteins/enzymes (e.g. Cas13 effector proteins) are preferred. In general and particularly in this embodiment and wild type, modified or mutated CRISPR effector proteins/enzymes (e.g. Cas13 effector proteins) is preferably driven by the CBh promoter. The RNA may preferably be driven by a Pol III promoter, such as a U6 promoter. Ideally the two are combined.

In some embodiments, a loop in the guide RNA or crRNA is provided. This may be a stem loop or a tetra loop. The loop is preferably GAAA, but it is not limited to this sequence or indeed to being only 4 bp in length. Indeed, preferred loop forming sequences for use in hairpin structures are four nucleotides in length, and most preferably have the sequence GAAA. However, longer or shorter loop sequences may be used, as may alternative sequences. The sequences preferably include a nucleotide triplet (for example, AAA), and an additional nucleotide (for example C or G). Examples of loop forming sequences include CAAA and AAAG.

In practicing any of the methods disclosed herein, a suitable vector can be introduced to a cell or an embryo via one or more methods known in the art, including without limitation, microinjection, electroporation, sonoporation, biolistics, calcium phosphate-mediated transfection, cationic transfection, liposome transfection, dendrimer transfection, heat shock transfection, nucleofection transfection, magnetofection, lipofection, impalefection, optical transfection, proprietary agent-enhanced uptake of nucleic acids, and delivery via liposomes, immunoliposomes, virosomes, or artificial virions. In some methods, the vector is introduced into an embryo by microinjection. The vector or vectors may be microinjected into the nucleus or the cytoplasm of the embryo. In some methods, the vector or vectors may be introduced into a cell by nucleofection.

Vectors can be designed for expression of CRISPR transcripts (e.g., nucleic acid transcripts, proteins, or enzymes) in prokaryotic or eukaryotic cells. For example, CRISPR transcripts can be expressed in bacterial cells such as *Escherichia coli*, insect cells (using baculovirus expression vectors), yeast cells, or mammalian cells. Suitable host cells are discussed further in Goeddel, GENE EXPRESSION TECHNOLOGY: METHODS IN ENZYMOLOGY 185, Academic Press, San Diego, Calif (1990). Alternatively, the recombinant expression vector can be transcribed and translated in vitro, for example using T7 promoter regulatory sequences and T7 polymerase.

Vectors may be introduced and propagated in a prokaryote or prokaryotic cell. In some embodiments, a prokaryote is used to amplify copies of a vector to be introduced into a eukaryotic cell or as an intermediate vector in the production of a vector to be introduced into a eukaryotic cell (e.g., amplifying a plasmid as part of a viral vector packaging system). In some embodiments, a prokaryote is used to amplify copies of a vector and express one or more nucleic acids, such as to provide a source of one or more proteins for delivery to a host cell or host organism. Expression of proteins in prokaryotes is most often carried out in *Escherichia coli* with vectors containing constitutive or inducible promoters directing the expression of either fusion or non-fusion proteins. Fusion vectors add a number of amino acids to a protein encoded therein, such as to the amino terminus of the recombinant protein. Such fusion vectors may serve one or more purposes, such as: (i) to increase expression of recombinant protein; (ii) to increase the solubility of the recombinant protein; and (iii) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Example fusion expression vectors include pGEX (Pharmacia Biotech Inc; Smith and Johnson, 1988. Gene 67: 31-40), pMAL (New England Biolabs, Beverly, Mass.) and pRIT5 (Pharmacia, Piscataway, N.J.) that fuse glutathione S-transferase (GST), maltose E binding protein, or protein A, respectively, to the target recombinant protein. Examples of suitable inducible non-fusion *E. coli* expression vectors include pTrc (Amrann et al., (1988) Gene 69:301-315) and pET lid (Studier et al., GENE EXPRESSION TECHNOLOGY: METHODS IN ENZYMOLOGY 185, Academic Press, San Diego, Calif. (1990) 60-89). In some embodiments, a vector is a yeast expression vector. Examples of vectors for expression in yeast *Saccharomyces* cerivisae include pYepSec1 (Baldari, et al., 1987. EMBO J. 6: 229-234), pMFa (Kuijan and Herskowitz, 1982. Cell 30: 933-943), pJRY88 (Schultz et al., 1987. Gene 54: 113-123), pYES2 (Invitrogen Corporation, San Diego, Calif.), and picZ (InVitrogen Corp, San Diego, Calif). In some embodiments, a vector drives protein expression in insect cells using baculovirus expression vectors. Baculovirus vectors available for expression of proteins in cultured insect cells (e.g., SF9 cells) include the pAc series (Smith, et al., 1983. Mol. Cell. Biol. 3: 2156-2165) and the pVL series (Lucklow and Summers, 1989. Virology 170: 31-39). In some embodiments, a vector is capable of driving expression of one or more sequences in mammalian cells using a mammalian expression vector. Examples of mammalian expression vectors include pCDM8 (Seed, 1987. Nature 329: 840) and pMT2PC (Kaufman, et al., 1987. EMBO J. 6: 187-195). When used in mammalian cells, the expression vector's control functions are typically provided by one or more regulatory elements. For example, commonly used promoters are derived from polyoma, adenovirus 2, cytomegalovirus, simian virus 40, and others disclosed herein and known in the art. For other suitable expression systems for both prokaryotic and eukaryotic cells see, e.g., Chapters 16 and 17 of Sambrook, et al., MOLECULAR CLONING: A LABORATORY MANUAL. 2nd ed., Cold Spring Harbor Laboratory, Cold Spring Harbor Laboratory Press, Cold Spring Harbor, N.Y., 1989. In some embodiments, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert, et al., 1987. Genes Dev. 1: 268-277), lymphoid-specific promoters (Calame and Eaton, 1988. Adv. Immunol. 43: 235-275), in particular promoters of T cell receptors (Winoto and Baltimore, 1989. EMBO J. 8: 729-733) and immunoglobulins (Baneiji, et al., 1983. Cell 33: 729-740; Queen and Baltimore, 1983. Cell 33: 741-748), neuron-specific promoters (e.g., the neurofilament promoter; Byrne and Ruddle, 1989. Proc. Natl. Acad. Sci. USA 86: 5473-5477), pancreas-specific promoters (Edlund, et al., 1985. Science 230: 912-916), and mammary gland-specific promoters (e.g., milk whey promoter; U.S. Pat. No. 4,873,316 and European Application Publication No. 264,166). Developmentally-regulated promoters are also encompassed, e.g., the murine hox promoters (Kessel and Gruss, 1990. Science 249: 374-379) and the α-fetoprotein promoter (Campes and Tilghman, 1989. Genes Dev. 3: 537-546). With regards to these prokaryotic and eukaryotic vectors, mention is made of U.S. Pat. No. 6,750,059, the contents of which are incorporated by reference herein in their entirety. Other embodiments of the invention may relate to the use of viral vectors, with regards to which mention is made of U.S. patent application Ser. No. 13/092,085, the contents of which are incorporated by reference herein in their entirety. Tissue-specific regulatory elements are known in the art and in this regard, mention is made of U.S. Pat. No. 7,776,321, the contents of which are incorporated by reference herein in their entirety.

In some embodiments, a regulatory element is operably linked to one or more elements of or encoding a CRISPR Cas system or complex so as to drive expression of the one or more elements of the CRISPR system. In general, CRISPRs (Clustered Regularly Interspaced Short Palindromic Repeats), also known as SPIDRs (SPacer Interspersed Direct Repeats), constitute a family of DNA loci that are usually specific to a particular bacterial species. The CRISPR locus comprises a distinct class of interspersed short sequence repeats (SSRs) that were recognized in *E. coli* (Ishino et al., J. Bacteriol., 169:5429-5433 [1987]; and Nakata et al., J. Bacteriol., 171:3553-3556 [1989]), and associated genes. Similar interspersed SSRs have been identified in *Haloferax mediterranei, Streptococcus pyogenes, Anabaena*, and *Mycobacterium tuberculosis* (See, Groenen et al., Mol. Microbiol., 10:1057-1065 [1993]; Hoe et al., Emerg. Infect. Dis., 5:254-263 [1999]; Masepohl et al., Biochim. Biophys. Acta 1307:26-30 [1996]; and Mojica et al., Mol. Microbiol., 17:85-93 [1995]). The CRISPR loci typically differ from other SSRs by the structure of the repeats, which have been termed short regularly spaced repeats (SRSRs) (Janssen et al., OMICS J. Integ. Biol., 6:23-33 [2002]; and Mojica et al., Mol. Microbiol., 36:244-

246 [2000]). In general, the repeats are short elements that occur in clusters that are regularly spaced by unique intervening sequences with a substantially constant length (Mojica et al., [2000], supra). Although the repeat sequences are highly conserved between strains, the number of interspersed repeats and the sequences of the spacer regions typically differ from strain to strain (van Embden et al., J. Bacteriol., 182:2393-2401 [2000]). CRISPR loci have been identified in more than 40 prokaryotes (See e.g., Jansen et al., Mol. Microbiol., 43:1565-1575 [2002]; and Mojica et al., [2005]) including, but not limited to Aeropyrum, *Pyrobaculum, Sulfolobus, Archaeoglobus, Halocarcula, Methanobacterium, Methanococcus, Methanosarcina, Methanopyrus, Pyrococcus, Picrophilus, Thermoplasma, Corynebacterium, Mycobacterium, Streptomyces, Aquifex, Porphyromonas, Chlorobium, Thermus, Bacillus, Listeria, Staphylococcus, Clostridium, Thermoanaerobacter, Mycoplasma, Fusobacterium, Azarcus, Chromobacterium, Neisseria, Nitrosomonas, Desulfovibrio, Geobacter, Myxococcus, Campylobacter, Wolinella, Acinetobacter, Erwinia, Escherichia, Legionella, Methylococcus, Pasteurella, Photobacterium, Salmonella, Xanthomonas, Yersinia, Treponema*, and *Thermotoga.*

In general, “RNA-targeting system” as used in the present application refers collectively to transcripts and other elements involved in the expression of or directing the activity of RNA-targeting CRISPR-associated 13 (“Cas13”) genes (also referred to herein as an effector protein), including sequences encoding a RNA-targeting Cas (effector) protein and a guide RNA (or crRNA sequence), with reference to the mutated CRISPR-Cas as herein discussed. In general, a RNA-targeting system is characterized by elements that promote the formation of a RNA-targeting complex at the site of a target sequence. In the context of formation of a RNA-targeting complex, “target sequence” refers to a RNA sequence to which a guide sequence (or the guide or of the crRNA) is designed to have complementarity, where hybridization between a target sequence and a guide RNA promotes the formation of a RNA-targeting complex. Full complementarity is not necessarily required, provided there is sufficient complementarity to cause hybridization and promote formation of a RNA-targeting complex. In some embodiments, a target sequence is located in the nucleus or cytoplasm of a cell. In some embodiments, the target sequence may be within an organelle of a eukaryotic cell. A sequence or template that may be used for recombination into the targeted locus comprising the target sequences is referred to as an “editing template” or “editing RNA” or “editing sequence”. In aspects of the invention, an exogenous template RNA may be referred to as an editing template. In an aspect of the invention the recombination is homologous recombination. In general, a guide sequence is any polynucleotide sequence having sufficient complementarity with a target polynucleotide sequence to hybridize with the target sequence and direct sequence-specific binding of a nucleic acid-targeting complex to the target sequence. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g. the Burrows Wheeler Aligner), ClustalW, Clustal X, BLAT, Novoalign (Novocraft Technologies, ELAND (Illumina, San Diego, CA), SOAP (available at soap.genomics.org.cn), and Maq (available at maq.sourceforge.net). In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20, 15, 12, or fewer nucleotides in length. The ability of a guide sequence to direct sequence-specific binding of a RNA-targeting complex to a target sequence may be assessed by any suitable assay. A template polynucleotide may be of any suitable length, such as about or more than about 10, 15, 20, 25, 50, 75, 100, 150, 200, 500, 1000, or more nucleotides in length. In some embodiments, the template polynucleotide is complementary to a portion of a polynucleotide comprising the target sequence. When optimally aligned, a template polynucleotide might overlap with one or more nucleotides of a target sequences (e.g. about or more than about 1, 5, 10, 15, 20, 25, 30, 35, 40, 45, 50, 60, 70, 80, 90, 100 or more nucleotides). In some embodiments, when a template sequence and a polynucleotide comprising a target sequence are optimally aligned, the nearest nucleotide of the template polynucleotide is within about 1, 5, 10, 15, 20, 25, 50, 75, 100, 200, 300, 400, 500, 1000, 5000, 10000, or more nucleotides from the target sequence. In some embodiments, the RNA-targeting effector protein is part of a fusion protein comprising one or more heterologous protein domains (e.g., about or more than about 1, 2, 3, 4, 5, 6, 7, 8, 9, 10, or more domains in addition to the nucleic acid-targeting effector protein). In some embodiments, the CRISPR Cas effector protein/enzyme is part of a fusion protein comprising one or more heterologous protein domains (e.g. about or more than about 1, 2, 3, 4, 5, 6, 7, 8, 9, 10, or more domains in addition to the CRISPR Cas enzyme). Examples of protein domains that may be fused to an effector protein include, without limitation, epitope tags, reporter gene sequences, and protein domains having one or more of the following activities: methylase activity, demethylase activity, transcription activation activity, transcription repression activity, transcription release factor activity, histone modification activity, RNA cleavage activity and nucleic acid binding activity. Non-limiting examples of epitope tags include histidine (His) tags, V5 tags, FLAG tags, influenza hemagglutinin (HA) tags, Myc tags, VSV-G tags, and thioredoxin (Trx) tags. Examples of reporter genes include, but are not limited to, glutathione-S-transferase (GST), horseradish peroxidase (HRP), chloramphenicol acetyltransferase (CAT) beta-galactosidase, beta-glucuronidase, luciferase, green fluorescent protein (GFP), HcRed, DsRed, cyan fluorescent protein (CFP), yellow fluorescent protein (YFP), and autofluorescent proteins including blue fluorescent protein (BFP). A nucleic acid-targeting effector protein may be fused to a gene sequence encoding a protein or a fragment of a protein that bind DNA molecules or bind other cellular molecules, including but not limited to maltose binding protein (MBP), S-tag, Lex A DNA binding domain (DBD) fusions, GAL4 DNA binding domain fusions, and herpes simplex virus (HSV) BP16 protein fusions. Additional domains that may form part of a fusion protein comprising a nucleic acid-targeting effector protein are described in US20110059502, incorporated herein by reference. In some embodiments, a tagged nucleic acid-targeting effector protein is used to identify the location of a target sequence. In some embodiments, a CRISPR Cas enzyme may form a component of an inducible system. The inducible nature of the system would allow for spatiotemporal control of gene editing or gene expression using a form of energy. The form of energy may include but is not limited to electromagnetic radiation, sound energy, chemical energy and thermal energy. Examples of inducible system include tetracycline inducible promoters (Tet-On or Tet-Off), small molecule two-hybrid transcription activations systems (FKBP, ABA, etc), or light inducible systems (Phytochrome, LOV domains, or cryptochrome). In one embodiment, the CRISPR CRISPR-Cas enzyme may be a part of a Light Inducible Transcriptional Effector (LITE) to direct changes in transcriptional activity in a sequence-specific manner. The components of a light may include a CRISPR enzyme, a light-responsive cytochrome heterodimer (e.g. from *Arabidopsis thaliana*), and a transcriptional activation/repression domain. Further examples of inducible DNA binding proteins and methods for their use are provided in U.S. 61/736,465 and U.S. 61/721,283 and WO 2014/018423 and U.S. Pat. Nos. 8,889,418, 8,895,308, US20140186919, US20140242700, US20140273234, US20140335620, WO2014093635, which is hereby incorporated by reference in its entirety. In some aspects, the invention provides methods comprising delivering one or more polynucleotides, such as or one or more vectors as described herein, one or more transcripts thereof, and/or one or proteins transcribed therefrom, to a host cell. In some aspects, the invention further provides cells produced by such methods, and organisms (such as animals, plants, or fungi) comprising or produced from such cells. In some embodiments, a RNA-targeting effector protein in combination with (and optionally complexed with) a guide RNA or crRNA is delivered to a cell. Conventional viral and non-viral based gene transfer methods can be used to introduce nucleic acids in mammalian cells or target tissues. Such methods can be used to administer nucleic acids encoding components of a RNA-targeting system to cells in culture, or in a host organism. Non-viral vector delivery systems include DNA plasmids, RNA (e.g. a transcript of a vector described herein), naked nucleic acid, and nucleic acid complexed with a delivery vehicle, such as a liposome. Viral vector delivery systems include DNA and RNA viruses, which have either episomal or integrated genomes after delivery to the cell. For a review of gene therapy procedures, see Anderson, Science 256:808-813 (1992); Nabel & Felgner, TIBTECH 11:211-217 (1993); Mitani & Caskey, TIBTECH 11:162-166 (1993); Dillon, TIBTECH 11:167-175 (1993); Miller, Nature 357:455-460 (1992); Van Brunt, Biotechnology 6(10):1149-1154 (1988); Vigne, Restorative Neurology and Neuroscience 8:35-36 (1995); Kremer & Perricaudet, British Medical Bulletin 51(1):31-44 (1995); Haddada et al., in Current Topics in Microbiology and Immunology, Doerfler and Bohm (eds) (1995); and Yu et al., Gene Therapy 1:13-26 (1994). Methods of non-viral delivery of nucleic acids include lipofection, nucleofection, microinjection, biolistics, virosomes, liposomes, immunoliposomes, polycation or lipid:nucleic acid conjugates, naked DNA, artificial virions, and agent-enhanced uptake of DNA. Lipofection is described in e.g., U.S. Pat. Nos. 5,049,386, 4,946,787; and 4,897,355) and lipofection reagents are sold commercially (e.g., Transfectam™ and Lipofectin™). Cationic and neutral lipids that are suitable for efficient receptor-recognition lipofection of polynucleotides include those of Felgner, WO 91/17424; WO 91/16024. Delivery can be to cells (e.g. in vitro or ex vivo administration) or target tissues (e.g. in vivo administration).

The nucleic acids-targeting systems, the vector systems, the vectors and the compositions described herein may be used in various nucleic acids-targeting applications, altering or modifying synthesis of a gene product, such as a protein, nucleic acids cleavage, nucleic acids editing, nucleic acids splicing; trafficking of target nucleic acids, tracing of target nucleic acids, isolation of target nucleic acids, visualization of target nucleic acids, etc.

Exemplary Delivery Methods

Through this disclosure and the knowledge in the art, TALEs, CRISPR-Cas systems, or components thereof or nucleic acid molecules thereof (including, for instance HDR template) or nucleic acid molecules encoding or providing components thereof may be delivered by a delivery system herein described both generally and in detail.

Vector delivery, e.g., plasmid, viral delivery: The CRISPR enzyme, and/or any of the present RNAs, for instance a guide RNA, can be delivered using any suitable vector, e.g., plasmid or viral vectors, such as adeno associated virus (AAV), lentivirus, adenovirus or other viral vector types, or combinations thereof. Effector proteins and one or more guide RNAs can be packaged into one or more vectors, e.g., plasmid or viral vectors. In some embodiments, the vector, e.g., plasmid or viral vector is delivered to the tissue of interest by, for example, an intramuscular injection, while other times the delivery is via intravenous, transdermal, intranasal, oral, mucosal, or other delivery methods. Such delivery may be either via a single dose, or multiple doses. One skilled in the art understands that the actual dosage to be delivered herein may vary greatly depending upon a variety of factors, such as the vector choice, the target cell, organism, or tissue, the general condition of the subject to be treated, the degree of transformation/modification sought, the administration route, the administration mode, the type of transformation/modification sought, etc.

Such a dosage may further contain, for example, a carrier (water, saline, ethanol, glycerol, lactose, sucrose, calcium phosphate, gelatin, dextran, agar, pectin, peanut oil, sesame oil, etc.), a diluent, a pharmaceutically-acceptable carrier (e.g., phosphate-buffered saline), a pharmaceutically-acceptable excipient, and/or other compounds known in the art. The dosage may further contain one or more pharmaceutically acceptable salts such as, for example, a mineral acid salt such as a hydrochloride, a hydrobromide, a phosphate, a sulfate, etc.; and the salts of organic acids such as acetates, propionates, malonates, benzoates, etc. Additionally, auxiliary substances, such as wetting or emulsifying agents, pH buffering substances, gels or gelling materials, flavorings, colorants, microspheres, polymers, suspension agents, etc. may also be present herein. In addition, one or more other conventional pharmaceutical ingredients, such as preservatives, humectants, suspending agents, surfactants, antioxidants, anticaking agents, fillers, chelating agents, coating agents, chemical stabilizers, etc. may also be present, especially if the dosage form is a reconstitutable form. Suitable exemplary ingredients include microcrystalline cellulose, carboxymethylcellulose sodium, polysorbate 80, phenylethyl alcohol, chlorobutanol, potassium sorbate, sorbic acid, sulfur dioxide, propyl gallate, the parabens, ethyl vanillin, glycerin, phenol, parachlorophenol, gelatin, albumin and a combination thereof. A thorough discussion of pharmaceutically acceptable excipients is available in REMINGTON'S PHARMACEUTICAL SCIENCES (Mack Pub. Co., N. J. 1991) which is incorporated by reference herein.

In an embodiment herein the delivery is via an adenovirus, which may be at a single booster dose containing at least $1\times10^5$ particles (also referred to as particle units, pu) of adenoviral vector. In an embodiment herein, the dose preferably is at least about $1\times10^6$ particles (for example, about $1\times10^6$-$1\times10^{12}$ particles), more preferably at least about $1\times10^7$ particles, more preferably at least about $1\times10^8$ particles (e.g., about $1\times10^8$-$1\times10^{11}$ particles or about $1\times10^8$-$1\times10^{12}$ particles), and most preferably at least about $1\times10^0$ particles (e.g., about $1\times10^9$-$1\times10^{10}$ particles or about $1\times10^9$-$1\times10^{12}$ particles), or even at least about $1\times10^{10}$ particles (e.g., about $1\times10^{10}$-$1\times10^{12}$ particles) of the adenoviral vector. Alternatively, the dose comprises no more than about $1\times10^{14}$ particles, preferably no more than about $1\times10^{13}$ particles, even more preferably no more than about $1\times10^{12}$ particles, even more preferably no more than about $1\times10^{11}$ particles, and most preferably no more than about $1\times10^{10}$ particles (e.g., no more than about $1\times10^9$ articles). Thus, the dose may contain a single dose of adenoviral vector with, for example, about $1\times10^6$ particle units (pu), about $2\times10^6$ pu, about $4\times10^6$ pu, about $1\times10^7$ pu, about $2\times10^7$ pu, about $4\times10^7$ pu, about $1\times10^8$ pu, about $2\times10^8$ pu, about $4\times10^8$ pu, about $1\times10^9$ pu, about $2\times10^9$ pu, about $4\times10^9$ pu, about $1\times10^{10}$ pu, about $2\times10^{10}$ pu, about $4\times10^{10}$ pu, about $1\times10^{11}$ pu, about $2\times10^{11}$ pu, about $4\times10^{11}$ pu, about $1\times10^{12}$ pu, about $2\times10^{12}$ pu, or about $4\times10^{12}$ pu of adenoviral vector. See, for example, the adenoviral vectors in U.S. Pat. No. 8,454,972 B2 to Nabel, et. al., granted on Jun. 4, 2013; incorporated by reference herein, and the dosages at col 29, lines 36-58 thereof. In an embodiment herein, the adenovirus is delivered via multiple doses.

In an embodiment herein, the delivery is via an AAV. A therapeutically effective dosage for in vivo delivery of the AAV to a human is believed to be in the range of from about 20 to about 50 ml of saline solution containing from about $1\times10^{10}$ to about $1\times10^{10}$ functional AAV/ml solution. The dosage may be adjusted to balance the therapeutic benefit against any side effects. In an embodiment herein, the AAV dose is generally in the range of concentrations of from about $1\times10^5$ to $1\times10^{50}$ genomes AAV, from about $1\times10^8$ to $1\times10^{20}$ genomes AAV, from about $1\times10^{10}$ to about $1\times10^{16}$ genomes, or about $1\times10^{11}$ to about $1\times10^{16}$ genomes AAV. A human dosage may be about $1\times10^{13}$ genomes AAV. Such concentrations may be delivered in from about 0.001 ml to about 100 ml, about 0.05 to about 50 ml, or about 10 to about 25 ml of a carrier solution. Other effective dosages can be readily established by one of ordinary skill in the art through routine trials establishing dose response curves. See, for example, U.S. Pat. No. 8,404,658 B2 to Hajjar, et al., granted on Mar. 26, 2013, at col. 27, lines 45-60.

In an embodiment herein the delivery is via a plasmid. In such plasmid compositions, the dosage should be a sufficient amount of plasmid to elicit a response. For instance, suitable quantities of plasmid DNA in plasmid compositions can be from about 0.1 to about 2 mg, or from about 1 μg to about 10 μg per 70 kg individual. Plasmids of the invention will generally comprise (i) a promoter; (ii) a sequence encoding an nucleic acid-targeting CRISPR enzyme, operably linked to said promoter; (iii) a selectable marker; (iv) an origin of replication; and (v) a transcription terminator downstream of and operably linked to (ii). The plasmid can also encode the RNA components of a CRISPR complex, but one or more of these may instead be encoded on a different vector.

The doses herein are based on an average 70 kg individual. The frequency of administration is within the ambit of the medical or veterinary practitioner (e.g., physician, veterinarian), or scientist skilled in the art. It is also noted that mice used in experiments are typically about 20 g and from mice experiments one can scale up to a 70 kg individual.

In some embodiments the RNA molecules of the invention are delivered in liposome or lipofectin formulations and the like and can be prepared by methods well known to those skilled in the art. Such methods are described, for example, in U.S. Pat. Nos. 5,593,972, 5,589,466, and 5,580,859, which are herein incorporated by reference. Delivery systems aimed specifically at the enhanced and improved delivery of siRNA into mammalian cells have been developed, (see, for example, Shen et al FEBS Let. 2003, 539: 111-114; Xia et al., Nat. Biotech. 2002, 20:1006-1010; Reich et al., Mol. Vision. 2003, 9: 210-216; Sorensen et al., J. Mol. Biol. 2003, 327: 761-766; Lewis et al., Nat. Gen. 2002, 32: 107-108 and Simeoni et al., NAR 2003, 31, 11: 2717-2724) and may be applied to the present invention. siRNA has recently been successfully used for inhibition of gene expression in primates (see for example. Tolentino et al., Retina 24(4):660 which may also be applied to the present invention.

Indeed, RNA delivery is a useful method of in vivo delivery. It is possible to deliver nucleic acid-targeting Cas protein and guide RNA (and, for instance, HR repair template) into cells using liposomes or particles. Thus delivery of the nucleic acid-targeting CRISPR-Cas protein and/or delivery of the guide RNAs or crRNAs of the invention may be in RNA form and via microvesicles, liposomes or particles. For example, CRISPR-Cas mRNA and guide RNA or crRNA can be packaged into liposomal particles for delivery in vivo. Liposomal transfection reagents such as lipofectamine from Life Technologies and other reagents on the market can effectively deliver RNA molecules into the liver.

Means of delivery of RNA also preferred include delivery of RNA via nanoparticles (Cho, S., Goldberg, M., Son, S., Xu, Q., Yang, F., Mei, Y., Bogatyrev, S., Langer, R. and Anderson, D., Lipid-like nanoparticles for small interfering RNA delivery to endothelial cells, Advanced Functional Materials, 19: 3112-3118, 2010) or exosomes (Schroeder, A., Levins, C., Cortez, C., Langer, R., and Anderson, D., Lipid-based nanotherapeutics for siRNA delivery, Journal of Internal Medicine, 267: 9-21, 2010, PMID: 20059641). Indeed, exosomes have been shown to be particularly useful in delivery siRNA, a system with some parallels to the RNA-targeting system. For instance, El-Andaloussi S, et al. ("Exosome-mediated delivery of siRNA in vitro and in vivo." Nat Protoc. 2012 December; 7(12):2112-26. doi: 10.1038/nprot.2012.131. Epub 2012 Nov. 15.) describe how exosomes are promising tools for drug delivery across different biological barriers and can be harnessed for delivery of siRNA in vitro and in vivo. Their approach is to generate targeted exosomes through transfection of an expression vector, comprising an exosomal protein fused with a peptide ligand. The exosomes are then purify and characterized from transfected cell supernatant, then RNA is loaded into the exosomes. Delivery or administration according to the invention can be performed with exosomes, in particular but not limited to the brain. Vitamin E (α-tocopherol) may be conjugated with nucleic acid-targeting Cas protein and delivered to the brain along with high density lipoprotein (HDL), for example in a similar manner as was done by Uno et al. (HUMAN GENE THERAPY 22:711-719 (June 2011)) for delivering short-interfering RNA (siRNA) to the brain. Mice were infused via Osmotic minipumps (model 1007D; Alzet, Cupertino, CA) filled with phosphate-buffered saline (PBS) or free TocsiBACE or Toc-siBACE/HDL and connected with Brain Infusion Kit 3 (Alzet). A brain-infusion cannula was placed about 0.5 mm posterior to the bregma at midline for infusion into the dorsal third ventricle. Uno et al. found that as little as 3 nmol of Toc-siRNA with HDL could induce a target reduction in comparable degree by the same ICV infusion method. A similar dosage of nucleic acid-targeting effector protein conjugated to α-tocopherol and co-administered with HDL targeted to the brain may be contemplated for humans in the present invention, for example, about 3 nmol to about 3 μmol of nucleic acid-targeting effector protein targeted to the brain may be contemplated. Zou et al. ((HUMAN GENE THERAPY 22:465-475 (April 2011)) describes a method of lentiviral-mediated delivery of short-hairpin RNAs targeting PKCγ for in vivo gene silencing in the spinal cord of rats. Zou et al. administered about 10 μl of a recombinant lentivirus having a titer of $1\times10^9$ transducing units (TU)/ml by an intrathecal catheter. A similar dosage of nucleic acid-targeting effector protein expressed in a lentiviral vector targeted to the brain may be contemplated for humans in the present invention, for example, about 10-50 ml of nucleic acid-targeting effector protein targeted to the brain in a lentivirus having a titer of $1\times10^9$ transducing units (TU)/ml may be contemplated.

In terms of local delivery to the brain, this can be achieved in various ways. For instance, material can be delivered intrastriatally e.g., by injection. Injection can be performed stereotactically via a craniotomy.

Packaging and Promoters Generally

Ways to package RNA-targeting effector protein (CRISPR-Cas proteins) coding nucleic acid molecules, e.g., DNA, into vectors, e.g., viral vectors, to mediate genome modification in vivo include:

Single Virus Vector:

Vector containing two or more expression cassettes:

Promoter—nucleic acid-targeting effector protein coding nucleic acid molecule-terminator Promoter—guide RNA1-terminator Promoter—guide RNA (N)-terminator (up to size limit of vector)

Double Virus Vector:

Vector 1 containing one expression cassette for driving the expression of RNA-targeting effector protein (CRISPR-Cas)

Promoter—RNA-targeting effector (CRISPR-Cas) protein coding nucleic acid molecule-terminator Vector 2 containing one more expression cassettes for driving the expression of one or more guideRNAs or crRNAs Promoter—guide RNA1 or crRNA1-terminator Promoter—guide RNA1 (N) or crRNA1 (N)-terminator (up to size limit of vector).

The promoter used to drive RNA-targeting effector protein coding nucleic acid molecule expression can include AAV ITR can serve as a promoter: this is advantageous for eliminating the need for an additional promoter element (which can take up space in the vector). The additional space freed up can be used to drive the expression of additional elements (gRNA, etc.). Also, ITR activity is relatively weaker, so can be used to reduce potential toxicity due to over expression of nucleic acid-targeting effector protein. For ubiquitous expression, can use promoters: CMV, CAG, CBh, PGK, SV40, Ferritin heavy or light chains, etc. For brain or other CNS expression, can use promoters: SynapsinI for all neurons, CaMKIIalpha for excitatory neurons, GAD67 or GAD65 or VGAT for GABAergic neurons, etc. For liver expression, can use Albumin promoter. For lung expression, can use SP-B. For endothelial cells, can use ICAM. For hematopoietic cells can use IFNbeta or CD45. For Osteoblasts can use OG-2. The promoter used to drive guide RNA can include: Pol III promoters such as U6 or H1; Pol II promoter and intronic cassettes to express guide RNA or crRNA.

Adeno Associated Virus (AAV)

CRISPR-Cas and one or more guide RNA or crRNA can be delivered using adeno associated virus (AAV), lentivirus, adenovirus or other plasmid or viral vector types, in particular, using formulations and doses from, for example, U.S. Pat. No. 8,454,972 (formulations, doses for adenovirus), U.S. Pat. No. 8,404,658 (formulations, doses for AAV) and U.S. Pat. No. 5,846,946 (formulations, doses for DNA plasmids) and from clinical trials and publications regarding the clinical trials involving lentivirus, AAV and adenovirus. For examples, for AAV, the route of administration, formulation and dose can be as in U.S. Pat. No. 8,454,972 and as in clinical trials involving AAV. For Adenovirus, the route of administration, formulation and dose can be as in U.S. Pat. No. 8,404,658 and as in clinical trials involving adenovirus. For plasmid delivery, the route of administration, formulation and dose can be as in U.S. Pat. No. 5,846,946 and as in clinical studies involving plasmids. Doses may be based on or extrapolated to an average 70 kg individual (e.g., a male adult human), and can be adjusted for patients, subjects, mammals of different weight and species. Frequency of administration is within the ambit of the medical or veterinary practitioner (e.g., physician, veterinarian), depending on usual factors including the age, sex, general health, other conditions of the patient or subject and the particular condition or symptoms being addressed. The viral vectors can be injected into the tissue of interest. For cell-type specific genome modification, the expression of RNA-targeting effector protein (CRISPR-Cas effector protein) can be driven by a cell-type specific promoter. For example, liver-specific expression might use the Albumin promoter and neuron-specific expression (e.g., for targeting CNS disorders) might use the Synapsin I promoter. In terms of in vivo delivery, AAV is advantageous over other viral vectors for a couple of reasons: Low toxicity (this may be due to the purification method not requiring ultra centrifugation of cell particles that can activate the immune response) and Low probability of causing insertional mutagenesis because it doesn't integrate into the host genome.

AAV has a packaging limit of 4.5 or 4.75 Kb. This means that the RNA-targeting effector protein (CRISPR-Cas effector protein) coding sequence as well as a promoter and transcription terminator have to be all fit into the same viral vector. As to AAV, the AAV can be AAV1, AAV2, AAV5 or any combination thereof. One can select the AAV of the AAV with regard to the cells to be targeted; e.g., one can select AAV serotypes 1, 2, 5 or a hybrid capsid AAV1, AAV2, AAV5 or any combination thereof for targeting brain or neuronal cells; and one can select AAV4 for targeting cardiac tissue. AAV8 is useful for delivery to the liver. The herein promoters and vectors are preferred individually. A tabulation of certain AAV serotypes as to these cells (see Grimm, D. et al, J. Virol. 82: 5887-5911 (2008)) is as follows:

TABLE 9

| Cell Line | AAV-1 | AAV-2 | AAV-3 | AAV-4 | AAV-5 | AAV-6 | AAV-8 | AAV-9 |
|---|---|---|---|---|---|---|---|---|
| Huh-7 | 13 | 100 | 2.5 | 0.0 | 0.1 | 10 | 0.7 | 0.0 |
| HEK293 | 25 | 100 | 2.5 | 0.1 | 0.1 | 5 | 0.7 | 0.1 |
| HeLa | 3 | 100 | 2.0 | 0.1 | 6.7 | 1 | 0.2 | 0.1 |

TABLE 9-continued

| Cell Line | AAV-1 | AAV-2 | AAV-3 | AAV-4 | AAV-5 | AAV-6 | AAV-8 | AAV-9 |
|---|---|---|---|---|---|---|---|---|
| HepG2 | 3 | 100 | 16.7 | 0.3 | 1.7 | 5 | 0.3 | ND |
| Hep1A | 20 | 100 | 0.2 | 1.0 | 0.1 | 1 | 0.2 | 0.0 |
| 911 | 17 | 100 | 11 | 0.2 | 0.1 | 17 | 0.1 | ND |
| CHO | 100 | 100 | 14 | 1.4 | 333 | 50 | 10 | 1.0 |
| COS | 33 | 100 | 33 | 3.3 | 5.0 | 14 | 2.0 | 0.5 |
| MeWo | 10 | 100 | 20 | 0.3 | 6.7 | 10 | 1.0 | 0.2 |
| NIH3T3 | 10 | 100 | 2.9 | 2.9 | 0.3 | 10 | 0.3 | ND |
| A549 | 14 | 100 | 20 | ND | 0.5 | 10 | 0.5 | 0.1 |
| HT1180 | 20 | 100 | 10 | 0.1 | 0.3 | 33 | 0.5 | 0.1 |
| Monocytes | 1111 | 100 | ND | ND | 125 | 1429 | ND | ND |
| Immature DC | 2500 | 100 | ND | ND | 222 | 2857 | ND | ND |
| Mature DC | 2222 | 100 | ND | ND | 333 | 3333 | ND | ND |

Lentivirus

Lentiviruses are complex retroviruses that have the ability to infect and express their genes in both mitotic and post-mitotic cells. The most commonly known lentivirus is the human immunodeficiency virus (HIV), which uses the envelope glycoproteins of other viruses to target a broad range of cell types. Lentiviruses may be prepared as follows. After cloning pCasES10 (which contains a lentiviral transfer plasmid backbone), HEK293FT at low passage (p=5) were seeded in a T-75 flask to 50% confluence the day before transfection in DMEM with 10% fetal bovine serum and without antibiotics. After 20 hours, media was changed to OptiMEM (serum-free) media and transfection was done 4 hours later. Cells were transfected with 10 μg of lentiviral transfer plasmid (pCasES10) and the following packaging plasmids: 5 μg of pMD2.G (VSV-g pseudotype), and 7.5 ug of psPAX2 (gag/pol/rev/tat). Transfection was done in 4 mL OptiMEM with a cationic lipid delivery agent (50 uL Lipofectamine 2000 and 100 ul Plus reagent). After 6 hours, the media was changed to antibiotic-free DMEM with 10% fetal bovine serum. These methods use serum during cell culture, but serum-free methods are preferred.

Lentivirus may be purified as follows. Viral supernatants were harvested after 48 hours. Supernatants were first cleared of debris and filtered through a 0.45 um low protein binding (PVDF) filter. They were then spun in a ultracentrifuge for 2 hours at 24,000 rpm. Viral pellets were resuspended in 50 ul of DMEM overnight at 4 C. They were then aliquotted and immediately frozen at −80° C.

In another embodiment, minimal non-primate lentiviral vectors based on the equine infectious anemia virus (EIAV) are also contemplated, especially for ocular gene therapy (see, e.g., Balagaan, J Gene Med 2006; 8: 275-285). In another embodiment, RetinoStat®, an equine inffctious anemia virus-based lentiviral gene therapy vector that expresses angiostatic proteins endostatin and angiostatin that is delivered via a subretinal injection for the treatment of the web form of age-related macular degeneration is also contemplated (see, e.g., Binley et al., HUMAN GENE THERAPY 23:980-991 (September 2012)) and this vector may be modified for the nucleic acid-targeting system of the present invention.

In another embodiment, self-inactivating lentiviral vectors with an siRNA targeting a common exon shared by HIV tat/rev, a nucleolar-localizing TAR decoy, and an anti-CCR5-specific hammerhead ribozyme (see, e.g., DiGiusto et al. (2010) Sci Transl Med 2:36ra43) may be used/and or adapted to the nucleic acid-targeting system of the present invention. A minimum of 2.5×106 CD34+ cells per kilogram patient weight may be collected and prestimulated for 16 to 20 hours in X-VIVO 15 medium (Lonza) containing 2 μmol/L-glutamine, stem cell factor (100 ng/ml), Flt-3 ligand (Flt-3L) (100 ng/ml), and thrombopoietin (10 ng/ml) (CellGenix) at a density of 2×106 cells/ml. Prestimulated cells may be transduced with lentiviral at a multiplicity of infection of 5 for 16 to 24 hours in 75-cm2 tissue culture flasks coated with fibronectin (25 mg/cm2) (RetroNectin, Takara Bio Inc.).

Lentiviral vectors have been disclosed as in the treatment for Parkinson's Disease, see, e.g., US Patent Publication No. 20120295960 and U.S. Pat. Nos. 7,303,910 and 7,351,585. Lentiviral vectors have also been disclosed for the treatment of ocular diseases, see e.g., US Patent Publication Nos. 20060281180, 20090007284, US20110117189; US20090017543; US20070054961, US20100317109. Lentiviral vectors have also been disclosed for delivery to the brain, see, e.g., US Patent Publication Nos. US20110293571; US20110293571, US20040013648, US20070025970, US20090111106 and U.S. Pat. No. 7,259, 015.

RNA Delivery

RNA delivery: The nucleic acid-targeting CRISPR-Cas protein, and/or guide RNA, can also be delivered in the form of RNA. mRNA can be synthesized using a PCR cassette containing the following elements: T7_promoter-kozak sequence (GCCACC)-effector protrein-3' UTR from beta globin-polyA tail (a string of 120 or more adenines). The cassette can be used for transcription by T7 polymerase. Guide RNAs or crRNAs can also be transcribed using in vitro transcription from a cassette containing T7_promoter-GG-guide RNA or crRNA sequence.

Particle Delivery Systems and/or Formulations:

Several types of particle delivery systems and/or formulations are known to be useful in a diverse spectrum of biomedical applications. In general, a particle is defined as a small object that behaves as a whole unit with respect to its transport and properties. Particles are further classified according to diameter. Coarse particles cover a range between 2,500 and 10,000 nanometers. Fine particles are sized between 100 and 2,500 nanometers. Ultrafine particles, or nanoparticles, are generally between 1 and 100 nanometers in size. The basis of the 100-nm limit is the fact that novel properties that differentiate particles from the bulk material typically develop at a critical length scale of under 100 nm.

As used herein, a particle delivery system/formulation is defined as any biological delivery system/formulation which includes a particle in accordance with the present invention. A particle in accordance with the present invention is any entity having a greatest dimension (e.g. diameter) of less than 100 microns (μm). In some embodiments, inventive particles have a greatest dimension of less than 10 μm. In some embodiments, inventive particles have a greatest dimension of less than 2000 nanometers (nm). In some embodiments, inventive particles have a greatest dimension of less than 1000 nanometers (nm). In some embodiments, inventive particles have a greatest dimension of less than 900 nm, 800 nm, 700 nm, 600 nm, 500 nm, 400 nm, 300 nm, 200 nm, or 100 nm. Typically, inventive particles have a greatest dimension (e.g., diameter) of 500 nm or less. In some embodiments, inventive particles have a greatest dimension (e.g., diameter) of 250 nm or less. In some embodiments, inventive particles have a greatest dimension (e.g., diameter) of 200 nm or less. In some embodiments, inventive particles have a greatest dimension (e.g., diameter) of 150 nm or less. In some embodiments, inventive particles have a greatest dimension (e.g., diameter) of 100 nm or less. Smaller particles, e.g., having a greatest dimension of 50 nm or less are used in some embodiments of the invention. In some embodiments, inventive particles have a greatest dimension ranging between 25 nm and 200 nm.

Particle characterization (including e.g., characterizing morphology, dimension, etc.) is done using a variety of different techniques. Common techniques are electron microscopy (TEM, SEM), atomic force microscopy (AFM), dynamic light scattering (DLS), X-ray photoelectron spectroscopy (XPS), powder X-ray diffraction (XRD), Fourier transform infrared spectroscopy (FTIR), matrix-assisted laser desorption/ionization time-of-flight mass spectrometry (MALDI-TOF), ultraviolet-visible spectroscopy, dual polarisation interferometry and nuclear magnetic resonance (NMR). Characterization (dimension measurements) may be made as to native particles (i.e., preloading) or after loading of the cargo (herein cargo refers to e.g., one or more components of CRISPR-Cas system e.g., CRISPR-Cas enzyme or mRNA or guide RNA, or any combination thereof, and may include additional carriers and/or excipients) to provide particles of an optimal size for delivery for any in vitro, ex vivo and/or in vivo application of the present invention. In certain preferred embodiments, particle dimension (e.g., diameter) characterization is based on measurements using dynamic laser scattering (DLS). Mention is made of U.S. Pat. Nos. 8,709,843; 6,007,845; 5,855,913; 5,985,309; 5,543,158; and the publication by James E. Dahlman and Carmen Barnes et al. Nature Nanotechnology (2014) published online 11 May 2014, doi:10.1038/nnano.2014.84, concerning particles, methods of making and using them and measurements thereof. See also Dahlman et al. "Orthogonal gene control with a catalytically active Cas9 nuclease," Nature Biotechnology 33, 1159-1161 (November, 2015)

Particles delivery systems within the scope of the present invention may be provided in any form, including but not limited to solid, semi-solid, emulsion, or colloidal particles. As such any of the delivery systems described herein, including but not limited to, e.g., lipid-based systems, liposomes, micelles, microvesicles, exosomes, or gene gun may be provided as particle delivery systems within the scope of the present invention.

Particles

CRISPR-Cas mRNA and guide RNA or crRNA may be delivered simultaneously using particles or lipid envelopes; for instance, CRISPR enzyme and RNA of the invention, e.g., as a complex, can be delivered via a particle as in Dahlman et al., WO2015089419 A2 and documents cited therein, such as 7C1 (see, e.g., James E. Dahlman and Carmen Barnes et al. Nature Nanotechnology (2014) published online 11 May 2014, doi:10.1038/nnano.2014.84), e.g., delivery particle comprising lipid or lipidoid and hydrophilic polymer, e.g., cationic lipid and hydrophilic polymer, for instance wherein the cationic lipid comprises 1,2-dioleoyl-3-trimethylammonium-propane (DOTAP) or 1,2-ditetradecanoyl-sn-glycero-3-phosphocholine (DMPC) and/or wherein the hydrophilic polymer comprises ethylene glycol or polyethylene glycol (PEG); and/or wherein the particle further comprises cholesterol (e.g., particle from formulation 1=DOTAP 100, DMPC 0, PEG 0, Cholesterol 0; formulation number 2=DOTAP 90, DMPC 0, PEG 10, Cholesterol 0; formulation number 3=DOTAP 90, DMPC 0, PEG 5, Cholesterol 5), wherein particles are formed using an efficient, multistep process wherein first, effector protein and RNA are mixed together, e.g., at a 1:1 molar ratio, e.g., at room temperature, e.g., for 30 minutes, e.g., in sterile, nuclease free 1×PBS; and separately, DOTAP, DMPC, PEG, and cholesterol as applicable for the formulation are dissolved in alcohol, e.g., 100% ethanol; and, the two solutions are mixed together to form particles containing the complexes). CRISPR-Cas effector protein mRNA and guide RNA may be delivered simultaneously using particles or lipid envelopes. This Dahlman et al technology can be applied in the instant invention. An epoxide-modified lipid-polymer may be utilized to deliver the nucleic acid-targeting system of the present invention to pulmonary, cardiovascular or renal cells, however, one of skill in the art may adapt the system to deliver to other target organs. Dosage ranging from about 0.05 to about 0.6 mg/kg are envisioned. Dosages over several days or weeks are also envisioned, with a total dosage of about 2 mg/kg. For example, Su X, Fricke J, Kavanagh D G, Irvine D J ("In vitro and in vivo mRNA delivery using lipid-enveloped pH-responsive polymer nanoparticles" Mol Pharm. 2011 Jun. 6; 8(3):774-87. doi:10.1021/mp100390w. Epub 2011 Apr. 1) describes biodegradable core-shell structured particles with a poly(O-amino ester) (PBAE) core enveloped by a phospholipid bilayer shell. These were developed for in vivo mRNA delivery. The pH-responsive PBAE component was chosen to promote endosome disruption, while the lipid surface layer was selected to minimize toxicity of the polycation core. Such are, therefore, preferred for delivering RNA of the present invention.

In one embodiment, particles based on self-assembling bioadhesive polymers are contemplated, which may be applied to oral delivery of peptides, intravenous delivery of peptides and nasal delivery of peptides, all to the brain. Other embodiments, such as oral absorption and ocular delivery of hydrophobic drugs are also contemplated. The molecular envelope technology involves an engineered polymer envelope which is protected and delivered to the site of the disease (see, e.g., Mazza, M. et al. ACSNano, 2013. 7(2): 1016-1026; Siew, A., et al. Mol Pharm, 2012. 9(1):14-28; Lalatsa, A., et al. J Contr Rel, 2012. 161(2):523-36; Lalatsa, A., et al., Mol Pharm, 2012. 9(6):1665-80; Lalatsa, A., et al. Mol Pharm, 2012. 9(6):1764-74; Garrett, N. L., et al. J Biophotonics, 2012. 5(5-6):458-68; Garrett, N. L., et al. J Raman Spect, 2012. 43(5):681-688; Ahmad, S., et al. J Royal Soc Interface 2010. 7:S423-33; Uchegbu, I. F. Expert Opin Drug Deliv, 2006. 3(5):629-40; Qu, X., et al. Biomacromolecules, 2006. 7(12):3452-9 and Uchegbu, I. F., et al. Int J Pharm, 2001.224:185-199). Doses of about 5 mg/kg are contemplated, with single or multiple doses, depending on the target tissue.

Regarding particles, see, also Alabi et al., Proc Natl Acad Sci USA. 2013 Aug. 6; 110(32):12881-6; Zhang et al., Adv Mater. 2013 Sep. 6; 25(33):4641-5; Jiang et al., Nano Lett. 2013 Mar. 13; 13(3):1059-64; Karagiannis et al., ACS Nano.

2012 Oct. 23; 6(10):8484-7; Whitehead et al., ACS Nano. 2012 Aug. 28; 6(8):6922-9 and Lee et al., Nat Nanotechnol. 2012 Jun. 3; 7(6):389-93.

US patent application 20110293703 relates to lipidoid compounds are also particularly useful in the administration of polynucleotides, which may be applied to deliver the nucleic acid-targeting system of the present invention. In one aspect, the aminoalcohol lipidoid compounds are combined with an agent to be delivered to a cell or a subject to form microparticles, nanoparticles, liposomes, or micelles. The agent to be delivered by the particles, liposomes, or micelles may be in the form of a gas, liquid, or solid, and the agent may be a polynucleotide, protein, peptide, or small molecule. The aminoalcohol lipidoid compounds may be combined with other aminoalcohol lipidoid compounds, polymers (synthetic or natural), surfactants, cholesterol, carbohydrates, proteins, lipids, etc. to form the particles. These particles may then optionally be combined with a pharmaceutical excipient to form a pharmaceutical composition. US Patent Publication No. 20110293703 also provides methods of preparing the aminoalcohol lipidoid compounds. One or more equivalents of an amine are allowed to react with one or more equivalents of an epoxide-terminated compound under suitable conditions to form an aminoalcohol lipidoid compound of the present invention. In certain embodiments, all the amino groups of the amine are fully reacted with the epoxide-terminated compound to form tertiary amines. In other embodiments, all the amino groups of the amine are not fully reacted with the epoxide-terminated compound to form tertiary amines thereby resulting in primary or secondary amines in the aminoalcohol lipidoid compound. These primary or secondary amines are left as is or may be reacted with another electrophile such as a different epoxide-terminated compound. As will be appreciated by one skilled in the art, reacting an amine with less than excess of epoxide-terminated compound will result in a plurality of different aminoalcohol lipidoid compounds with various numbers of tails. Certain amines may be fully functionalized with two epoxide-derived compound tails while other molecules will not be completely functionalized with epoxide-derived compound tails. For example, a diamine or polyamine may include one, two, three, or four epoxide-derived compound tails off the various amino moieties of the molecule resulting in primary, secondary, and tertiary amines. In certain embodiments, all the amino groups are not fully functionalized. In certain embodiments, two of the same types of epoxide-terminated compounds are used. In other embodiments, two or more different epoxide-terminated compounds are used. The synthesis of the aminoalcohol lipidoid compounds is performed with or without solvent, and the synthesis may be performed at higher temperatures ranging from 30-100° C., preferably at approximately 50-90° C. The prepared aminoalcohol lipidoid compounds may be optionally purified. For example, the mixture of aminoalcohol lipidoid compounds may be purified to yield an aminoalcohol lipidoid compound with a particular number of epoxide-derived compound tails. Or the mixture may be purified to yield a particular stereo- or regioisomer. The aminoalcohol lipidoid compounds may also be alkylated using an alkyl halide (e.g., methyl iodide) or other alkylating agent, and/or they may be acylated.

US Patent Publication No. 20110293703 also provides libraries of aminoalcohol lipidoid compounds prepared by the inventive methods. These aminoalcohol lipidoid compounds may be prepared and/or screened using high-throughput techniques involving liquid handlers, robots, microtiter plates, computers, etc. In certain embodiments, the aminoalcohol lipidoid compounds are screened for their ability to transfect polynucleotides or other agents (e.g., proteins, peptides, small molecules) into the cell. US Patent Publication No. 20130302401 relates to a class of poly(beta-amino alcohols) (PBAAs) has been prepared using combinatorial polymerization. The inventive PBAAs may be used in biotechnology and biomedical applications as coatings (such as coatings of films or multilayer films for medical devices or implants), additives, materials, excipients, non-biofouling agents, micropatterning agents, and cellular encapsulation agents. When used as surface coatings, these PBAAs elicited different levels of inflammation, both in vitro and in vivo, depending on their chemical structures. The large chemical diversity of this class of materials allowed us to identify polymer coatings that inhibit macrophage activation in vitro. Furthermore, these coatings reduce the recruitment of inflammatory cells, and reduce fibrosis, following the subcutaneous implantation of carboxylated polystyrene microparticles. These polymers may be used to form polyelectrolyte complex capsules for cell encapsulation. The invention may also have many other biological applications such as antimicrobial coatings, DNA or siRNA delivery, and stem cell tissue engineering. The teachings of US Patent Publication No. 20130302401 may be applied to the nucleic acid-targeting system of the present invention.

In another embodiment, lipid nanoparticles (LNPs) are contemplated. An antitransthyretin small interfering RNA has been encapsulated in lipid nanoparticles and delivered to humans (see, e.g., Coelho et al., N Engl J Med 2013; 369:819-29), and such a system may be adapted and applied to the nucleic acid-targeting system of the present invention. Doses of about 0.01 to about 1 mg per kg of body weight administered intravenously are contemplated. Medications to reduce the risk of infusion-related reactions are contemplated, such as dexamethasone, acetampinophen, diphenhydramine or cetirizine, and ranitidine are contemplated. Multiple doses of about 0.3 mg per kilogram every 4 weeks for five doses are also contemplated. LNPs have been shown to be highly effective in delivering siRNAs to the liver (see, e.g., Tabernero et al., Cancer Discovery, April 2013, Vol. 3, No. 4, pages 363-470) and are therefore contemplated for delivering RNA encoding nucleic acid-targeting effector protein to the liver. A dosage of about four doses of 6 mg/kg of the LNP every two weeks may be contemplated. Tabernero et al. demonstrated that tumor regression was observed after the first 2 cycles of LNPs dosed at 0.7 mg/kg, and by the end of 6 cycles the patient had achieved a partial response with complete regression of the lymph node metastasis and substantial shrinkage of the liver tumors. A complete response was obtained after 40 doses in this patient, who has remained in remission and completed treatment after receiving doses over 26 months. Two patients with RCC and extrahepatic sites of disease including kidney, lung, and lymph nodes that were progressing following prior therapy with VEGF pathway inhibitors had stable disease at all sites for approximately 8 to 12 months, and a patient with PNET and liver metastases continued on the extension study for 18 months (36 doses) with stable disease. However, the charge of the LNP must be taken into consideration. As cationic lipids combined with negatively charged lipids to induce nonbilayer structures that facilitate intracellular delivery. Because charged LNPs are rapidly cleared from circulation following intravenous injection, ionizable cationic lipids with pKa values below 7 were developed (see, e.g., Rosin et al, Molecular Therapy, vol. 19, no. 12, pages 1286-2200, December 2011). Negatively charged polymers such as RNA may be loaded into LNPs at low pH values (e.g., pH 4) where the ionizable lipids display a positive charge. However, at physiological pH values, the LNPs exhibit a low surface charge compatible with longer circulation times. Four species of ionizable cationic lipids have been focused upon, namely 1,2-dilineoyl-3-dimethylammonium-propane (DLinDAP), 1,2-dilinoleyloxy-3-N,N-dimethylaminopropane (DLinDMA), 1,2-dilinoleyloxy-keto-N, N-dimethyl-3-aminopropane (DLinKDMA), and 1,2-dilinoleyl-4-(2-dimethylaminoethyl)-[1,3]-dioxolane (DLinKC2-DMA). It has been shown that LNP siRNA systems containing these lipids exhibit remarkably different gene silencing properties in hepatocytes in vivo, with potencies varying according to the series DLinKC2-DMA>DLinKDMA>DLinDMA>>DLinDAP employing a Factor VII gene silencing model (see, e.g., Rosin et al, Molecular Therapy, vol. 19, no. 12, pages 1286-2200, December 2011). A dosage of 1 g/ml of LNP or CRISPR-Cas RNA in or associated with the LNP may be contemplated, especially for a formulation containing DLinKC2-DMA.

Preparation of LNPs and CRISPR-Cas encapsulation may be used/and or adapted from Rosin et al, Molecular Therapy, vol. 19, no. 12, pages 1286-2200, December 2011). The cationic lipids 1,2-dilineoyl-3-dimethylammonium-propane (DLinDAP), 1,2-dilinoleyloxy-3-N,N-dimethylaminopropane (DLinDMA), 1,2-dilinoleyloxyketo-N,N-dimethyl-3-aminopropane (DLinK-DMA), 1,2-dilinoleyl-4-(2-dimethylaminoethyl)-[1,3]-dioxolane (DLinKC2-DMA), (3-o-[2"-(methoxypolyethyleneglycol 2000) succinoyl]-1,2-dimyristoyl-sn-glycol (PEG-S-DMG), and R-3-[(o-methoxy-poly(ethylene glycol)2000) carbamoyl]-1,2-dimyristyloxlpropyl-3-amine (PEG-C-DOMG) may be provided by Tekmira Pharmaceuticals (Vancouver, Canada) or synthesized. Cholesterol may be purchased from Sigma (St Louis, MO). The specific nucleic acid-targeting complex (CRISPR-Cas) RNA may be encapsulated in LNPs containing DLinDAP, DLinDMA, DLinK-DMA, and DLinKC2-DMA (cationic lipid:DSPC:CHOL:PEGS-DMG or PEG-C-DOMG at 40:10:40:10 molar ratios). When required, 0.2% SP-DiOC18 (Invitrogen, Burlington, Canada) may be incorporated to assess cellular uptake, intracellular delivery, and biodistribution. Encapsulation may be performed by dissolving lipid mixtures comprised of cationic lipid:DSPC:cholesterol:PEG-c-DOMG (40:10:40:10 molar ratio) in ethanol to a final lipid concentration of 10 mmol/1. This ethanol solution of lipid may be added drop-wise to 50 mmol/1 citrate, pH 4.0 to form multilamellar vesicles to produce a final concentration of 30% ethanol vol/vol. Large unilamellar vesicles may be formed following extrusion of multilamellar vesicles through two stacked 80 nm Nuclepore polycarbonate filters using the Extruder (Northern Lipids, Vancouver, Canada). Encapsulation may be achieved by adding RNA dissolved at 2 mg/ml in 50 mmol/1 citrate, pH 4.0 containing 30% ethanol vol/vol drop-wise to extruded preformed large unilamellar vesicles and incubation at 31° C. for 30 minutes with constant mixing to a final RNA/lipid weight ratio of 0.06/1 wt/wt. Removal of ethanol and neutralization of formulation buffer were performed by dialysis against phosphate-buffered saline (PBS), pH 7.4 for 16 hours using Spectra/Por 2 regenerated cellulose dialysis membranes. Particle size distribution may be determined by dynamic light scattering using a NICOMP 370 particle sizer, the vesicle/intensity modes, and Gaussian fitting (Nicomp Particle Sizing, Santa Barbara, CA). The particle size for all three LNP systems may be ~70 nm in diameter. RNA encapsulation efficiency may be determined by removal of free RNA using VivaPureD MiniH columns (Sartorius Stedim Biotech) from samples collected before and after dialysis. The encapsulated RNA may be extracted from the eluted particles and quantified at 260 nm. RNA to lipid ratio was determined by measurement of cholesterol content in vesicles using the Cholesterol E enzymatic assay from Wako Chemicals USA (Richmond, VA). In conjunction with the herein discussion of LNPs and PEG lipids, PEGylated liposomes or LNPs are likewise suitable for delivery of a nucleic acid-targeting system or components thereof. Preparation of large LNPs may be used/and or adapted from Rosin et al, Molecular Therapy, vol. 19, no. 12, pages 1286-2200, December 2011. A lipid premix solution (20.4 mg/ml total lipid concentration) may be prepared in ethanol containing DLinKC2-DMA, DSPC, and cholesterol at 50:10:38.5 molar ratios. Sodium acetate may be added to the lipid premix at a molar ratio of 0.75:1 (sodium acetate:DLinKC2-DMA). The lipids may be subsequently hydrated by combining the mixture with 1.85 volumes of citrate buffer (10 mmol/1, pH 3.0) with vigorous stirring, resulting in spontaneous liposome formation in aqueous buffer containing 35% ethanol. The liposome solution may be incubated at 37° C. to allow for time-dependent increase in particle size. Aliquots may be removed at various times during incubation to investigate changes in liposome size by dynamic light scattering (Zetasizer Nano Z S, Malvern Instruments, Worcestershire, UK). Once the desired particle size is achieved, an aqueous PEG lipid solution (stock=10 mg/ml PEG-DMG in 35% (vol/vol) ethanol) may be added to the liposome mixture to yield a final PEG molar concentration of 3.5% of total lipid. Upon addition of PEG-lipids, the liposomes should their size, effectively quenching further growth. RNA may then be added to the empty liposomes at a RNA to total lipid ratio of approximately 1:10 (wt:wt), followed by incubation for 30 minutes at 37° C. to form loaded LNPs. The mixture may be subsequently dialyzed overnight in PBS and filtered with a 0.45-μm syringe filter.

Spherical Nucleic Acid (SNA™) constructs and other particles (particularly gold particles) are also contemplated as a means to delivery nucleic acid-targeting system to intended targets. Significant data show that AuraSense Therapeutics' Spherical Nucleic Acid (SNA™) constructs, based upon nucleic acid-functionalized gold particles, are useful.

Literature that may be employed in conjunction with herein teachings include: Cutler et al., J. Am. Chem. Soc. 2011 133:9254-9257, Hao et al., Small. 2011 7:3158-3162, Zhang et al., ACS Nano. 2011 5:6962-6970, Cutler et al., J. Am. Chem. Soc. 2012 134:1376-1391, Young et al., Nano Lett. 2012 12:3867-71, Zheng et al., Proc. Natl. Acad. Sci. USA. 2012 109:11975-80, Mirkin, Nanomedicine 2012 7:635-638 Zhang et al., J. Am. Chem. Soc. 2012 134:16488-1691, Weintraub, Nature 2013 495:S14-S16, Choi et al., Proc. Natl. Acad. Sci. USA. 2013 110(19):7625-7630, Jensen et al., Sci. Transl. Med. 5, 209ra152 (2013) and Mirkin, et al., Small, 10:186-192.

Self-assembling particles with RNA may be constructed with polyethyleneimine (PEI) that is PEGylated with an Arg-Gly-Asp (RGD) peptide ligand attached at the distal end of the polyethylene glycol (PEG). This system has been used, for example, as a means to target tumor neovasculature expressing integrins and deliver siRNA inhibiting vascular endothelial growth factor receptor-2 (VEGF R2) expression and thereby achieve tumor angiogenesis (see, e.g., Schiffelers et al., Nucleic Acids Research, 2004, Vol. 32, No. 19). Nanoplexes may be prepared by mixing equal volumes of aqueous solutions of cationic polymer and nucleic acid to give a net molar excess of ionizable nitrogen (polymer) to phosphate (nucleic acid) over the range of 2 to 6. The electrostatic interactions between cationic polymers and nucleic acid resulted in the formation of polyplexes with average particle size distribution of about 100 nm, hence referred to here as nanoplexes. A dosage of about 100 to 200 mg of nucleic acid-targeting complex RNA is envisioned for delivery in the self-assembling particles of Schiffelers et al.

The nanoplexes of Bartlett et al. (PNAS, Sep. 25, 2007, vol. 104, no. 39) may also be applied to the present invention. The nanoplexes of Bartlett et al. are prepared by mixing equal volumes of aqueous solutions of cationic polymer and nucleic acid to give a net molar excess of ionizable nitrogen (polymer) to phosphate (nucleic acid) over the range of 2 to 6. The electrostatic interactions between cationic polymers and nucleic acid resulted in the formation of polyplexes with average particle size distribution of about 100 nm, hence referred to here as nanoplexes. The DOTA-siRNA of Bartlett et al. was synthesized as follows: 1,4,7,10-tetraazacyclododecane-1,4,7,10-tetraacetic acid mono(N-hydroxysuccinimide ester) (DOTA-NHSester) was ordered from Macrocyclics (Dallas, TX). The amine modified RNA sense strand with a 100-fold molar excess of DOTA-NHS-ester in carbonate buffer (pH 9) was added to a microcentrifuge tube. The contents were reacted by stirring for 4 h at room temperature. The DOTA-RNAsense conjugate was ethanol-precipitated, resuspended in water, and annealed to the unmodified antisense strand to yield DOTA-siRNA. All liquids were pretreated with Chelex-100 (Bio-Rad, Hercules, CA) to remove trace metal contaminants. Tf-targeted and nontargeted siRNA particles may be formed by using cyclodextrin-containing polycations. Typically, particles were formed in water at a charge ratio of 3 (+/−) and an siRNA concentration of 0.5 g/liter. One percent of the adamantane-PEG molecules on the surface of the targeted particles were modified with Tf (adamantane-PEG-Tf). The particles were suspended in a 5% (wt/vol) glucose carrier solution for injection.

Davis et al. (Nature, Vol 464, 15 Apr. 2010) conducts a RNA clinical trial that uses a targeted particle-delivery system (clinical trial registration number NCT00689065). Patients with solid cancers refractory to standard-of-care therapies are administered doses of targeted particles on days 1, 3, 8 and 10 of a 21-day cycle by a 30-min intravenous infusion. The particles comprise, consist essentially of, or consist of a synthetic delivery system containing: (1) a linear, cyclodextrin-based polymer (CDP), (2) a human transferrin protein (TF) targeting ligand displayed on the exterior of the nanoparticle to engage TF receptors (TFR) on the surface of the cancer cells, (3) a hydrophilic polymer (polyethylene glycol (PEG) used to promote nanoparticle stability in biological fluids), and (4) siRNA designed to reduce the expression of the RRM2 (sequence used in the clinic was previously denoted siR2B+5). The TFR has long been known to be upregulated in malignant cells, and RRM2 is an established anti-cancer target. These particles (clinical version denoted as CALAA-01) have been shown to be well tolerated in multi-dosing studies in non-human primates. Although a single patient with chronic myeloid leukemia has been administered siRNA by liposomal delivery, Davis et al.'s clinical trial is the initial human trial to systemically deliver siRNA with a targeted delivery system and to treat patients with solid cancer. To ascertain whether the targeted delivery system can provide effective delivery of functional siRNA to human tumours, Davis et al. investigated biopsies from three patients from three different dosing cohorts; patients A, B and C, all of whom had metastatic melanoma and received CALAA-01 doses of 18, 24 and 30 mg m-2 siRNA, respectively. Similar doses may also be contemplated for the nucleic acid-targeting system of the present invention. The delivery of the invention may be achieved with particles containing a linear, cyclodextrin-based polymer (CDP), a human transferrin protein (TF) targeting ligand displayed on the exterior of the particle to engage TF receptors (TFR) on the surface of the cancer cells and/or a hydrophilic polymer (for example, polyethylene glycol (PEG) used to promote particle stability in biological fluids).

In terms of this invention, it is preferred to have one or more components of RNA-targeting complex, e.g., nucleic acid-targeting effector (CRISPR-Cas) protein or mRNA therefor, or guide RNA or crRNA delivered using particles or lipid envelopes. Other delivery systems or vectors are may be used in conjunction with the particle aspects of the invention. Particles encompassed in the present invention may be provided in different forms, e.g., as solid particles (e.g., metal such as silver, gold, iron, titanium), non-metal, lipid-based solids, polymers), suspensions of particles, or combinations thereof. Metal, dielectric, and semiconductor particles may be prepared, as well as hybrid structures (e.g., core-shell particles). Particles made of semiconducting material may also be labeled quantum dots if they are small enough (typically sub 10 nm) that quantization of electronic energy levels occurs. Such nanoscale particles are used in biomedical applications as drug carriers or imaging agents and may be adapted for similar purposes in the present invention.

Semi-solid and soft particles have been manufactured, and are within the scope of the present invention. A prototype particle of semi-solid nature is the liposome. Various types of liposome particles are currently used clinically as delivery systems for anticancer drugs and vaccines. Particles with one half hydrophilic and the other half hydrophobic are termed Janus particles and are particularly effective for stabilizing emulsions. They can self-assemble at water/oil interfaces and act as solid surfactants.

U.S. Pat. No. 8,709,843, incorporated herein by reference, provides a drug delivery system for targeted delivery of therapeutic agent-containing particles to tissues, cells, and intracellular compartments. The invention provides targeted particles comprising polymer conjugated to a surfactant, hydrophilic polymer or lipid. U.S. Pat. No. 6,007,845, incorporated herein by reference, provides particles which have a core of a multiblock copolymer formed by covalently linking a multifunctional compound with one or more hydrophobic polymers and one or more hydrophilic polymers, and contain a biologically active material. U.S. Pat. No. 5,855,913, incorporated herein by reference, provides a particulate composition having aerodynamically light particles having a tap density of less than 0.4 g/cm3 with a mean diameter of between 5 μm and 30 μm, incorporating a surfactant on the surface thereof for drug delivery to the pulmonary system. U.S. Pat. No. 5,985,309, incorporated herein by reference, provides particles incorporating a surfactant and/or a hydrophilic or hydrophobic complex of a positively or negatively charged therapeutic or diagnostic agent and a charged molecule of opposite charge for delivery to the pulmonary system. U.S. Pat. No. 5,543,158, incorporated herein by reference, provides biodegradable injectable particles having a biodegradable solid core containing a biologically active material and poly(alkylene glycol) moieties on the surface. WO2012135025 (also published as US20120251560), incorporated herein by reference, describes conjugated polyethyleneimine (PEI) polymers and conjugated aza-macrocycles (collectively referred to as "conjugated lipomer" or "lipomers"). In certain embodiments, it can be envisioned that such methods and materials of herein-cited documents, e.g., conjugated lipomers can be used in the context of the nucleic acid-targeting system to achieve in vitro, ex vivo and in vivo genomic perturbations to modify gene expression, including modulation of protein expression.

ExosoMEs

Exosomes are endogenous nano-vesicles that transport RNAs and proteins, and which can deliver RNA to the brain and other target organs. To reduce immunogenicity, Alvarez-Erviti et al. (2011, Nat Biotechnol 29: 341) used self-derived dendritic cells for exosome production. Targeting to the brain was achieved by engineering the dendritic cells to express Lamp2b, an exosomal membrane protein, fused to the neuron-specific RVG peptide. Purified exosomes were loaded with exogenous RNA by electroporation. Intravenously injected RVG-targeted exosomes delivered GAPDH siRNA specifically to neurons, microglia, oligodendrocytes in the brain, resulting in a specific gene knockdown. Pre-exposure to RVG exosomes did not attenuate knockdown, and non-specific uptake in other tissues was not observed. The therapeutic potential of exosome-mediated siRNA delivery was demonstrated by the strong mRNA (60%) and protein (62%) knockdown of BACE1, a therapeutic target in Alzheimer's disease.

To obtain a pool of immunologically inert exosomes, Alvarez-Erviti et al. harvested bone marrow from inbred C57BL/6 mice with a homogenous major histocompatibility complex (MHC) haplotype. As immature dendritic cells produce large quantities of exosomes devoid of T-cell activators such as MHC-II and CD86, Alvarez-Erviti et al. selected for dendritic cells with granulocyte/macrophage-colony stimulating factor (GM-CSF) for 7 d. Exosomes were purified from the culture supernatant the following day using well-established ultracentrifugation protocols. The exosomes produced were physically homogenous, with a size distribution peaking at 80 nm in diameter as determined by particle tracking analysis (NTA) and electron microscopy. Alvarez-Erviti et al. obtained 6-12 μg of exosomes (measured based on protein concentration) per $10^6$ cells. Next, Alvarez-Erviti et al. investigated the possibility of loading modified exosomes with exogenous cargoes using electroporation protocols adapted for nanoscale applications. As electroporation for membrane particles at the nanometer scale is not well-characterized, nonspecific Cy5-labeled RNA was used for the empirical optimization of the electroporation protocol. The amount of encapsulated RNA was assayed after ultracentrifugation and lysis of exosomes. Electroporation at 400 V and 125 μF resulted in the greatest retention of RNA and was used for all subsequent experiments. Alvarez-Erviti et al. administered 150 μg of each BACE1 siRNA encapsulated in 150 μg of RVG exosomes to normal C57BL/6 mice and compared the knockdown efficiency to four controls: untreated mice, mice injected with RVG exosomes only, mice injected with BACE1 siRNA complexed to an in vivo cationic liposome reagent and mice injected with BACE1 siRNA complexed to RVG-9R, the RVG peptide conjugated to 9 D-arginines that electrostatically binds to the siRNA. Cortical tissue samples were analyzed 3 d after administration and a significant protein knockdown (45%, $P<0.05$, versus 62%, $P<0.01$) in both siRNA-RVG-9R-treated and siRNARVG exosome-treated mice was observed, resulting from a significant decrease in BACE1 mRNA levels (66% [+ or −]15%, $P<0.001$ and 61% [+ or −]13% respectively, $P<0.01$). Moreover, Applicants demonstrated a significant decrease (55%, $P<0.05$) in the total [beta]-amyloid 1-42 levels, a main component of the amyloid plaques in Alzheimer's pathology, in the RVG-exosome-treated animals. The decrease observed was greater than the 0-amyloid 1-40 decrease demonstrated in normal mice after intraventricular injection of BACE1 inhibitors. Alvarez-Erviti et al. carried out 5'-rapid amplification of cDNA ends (RACE) on BACE1 cleavage product, which provided evidence of RNAi-mediated knockdown by the siRNA. Finally, Alvarez-Erviti et al. investigated whether RNA-RVG exosomes induced immune responses in vivo by assessing IL-6, IP-10, TNFα and IFN-α serum concentrations. Following exosome treatment, nonsignificant changes in all cytokines were registered similar to siRNA-transfection reagent treatment in contrast to siRNA-RVG-9R, which potently stimulated IL-6 secretion, confirming the immunologically inert profile of the exosome treatment. Given that exosomes encapsulate only 20% of siRNA, delivery with RVG-exosome appears to be more efficient than RVG-9R delivery as comparable mRNA knockdown and greater protein knockdown was achieved with fivefold less siRNA without the corresponding level of immune stimulation. This experiment demonstrated the therapeutic potential of RVG-exosome technology, which is potentially suited for long-term silencing of genes related to neurodegenerative diseases. The exosome delivery system of Alvarez-Erviti et al. may be applied to deliver the nucleic acid-targeting system of the present invention to therapeutic targets, especially neurodegenerative diseases. A dosage of about 100 to 1000 mg of nucleic acid-targeting system encapsulated in about 100 to 1000 mg of RVG exosomes may be contemplated for the present invention.

El-Andaloussi et al. (Nature Protocols 7,2112-2126 (2012)) provides exosomes derived from cultured cells harnessed for delivery of RNA in vitro and in vivo. This protocol first describes the generation of targeted exosomes through transfection of an expression vector, comprising an exosomal protein fused with a peptide ligand. Next, El-Andaloussi et al. explain how to purify and characterize exosomes from transfected cell supernatant. Next, El-Andaloussi et al. detail crucial steps for loading RNA into exosomes. Finally, El-Andaloussi et al. outline how to use exosomes to efficiently deliver RNA in vitro and in vivo in mouse brain. Examples of anticipated results in which exosome-mediated RNA delivery is evaluated by functional assays and imaging are also provided. The entire protocol takes ~3 weeks. Delivery or administration according to the invention may be performed using exosomes produced from self-derived dendritic cells. From the herein teachings, this can be employed in the practice of the invention In another embodiment, the plasma exosomes of Wahlgren et al. (Nucleic Acids Research, 2012, Vol. 40, No. 17 e130) are contemplated. Exosomes are nano-sized vesicles (30-90 nm in size) produced by many cell types, including dendritic cells (DC), B cells, T cells, mast cells, epithelial cells and tumor cells. These vesicles are formed by inward budding of late endosomes and are then released to the extracellular environment upon fusion with the plasma membrane. Because exosomes naturally carry RNA between cells, this property may be useful in gene therapy, and from this disclosure can be employed in the practice of the instant invention. Exosomes from plasma can be prepared by centrifugation of buffy coat at 900 g for 20 min to isolate the plasma followed by harvesting cell supernatants, centrifuging at 300 g for 10 min to eliminate cells and at 16 500 g for 30 min followed by filtration through a 0.22 mm filter. Exosomes are pelleted by ultracentrifugation at 120 000 g for 70 min. Chemical transfection of siRNA into exosomes is carried out according to the manufacturer's instructions in RNAi Human/Mouse Starter Kit (Quiagen, Hilden, Germany). siRNA is added to 100 ml PBS at a final concentration of 2 mmol/ml. After adding HiPerFect transfection reagent, the mixture is incubated for 10 min at RT. In order to remove the excess of micelles, the exosomes are re-isolated using aldehyde/sulfate latex beads. The chemical transfection of nucleic acid-targeting system into exosomes may be conducted similarly to siRNA. The exosomes may be co-cultured with monocytes and lymphocytes isolated from the peripheral blood of healthy donors. Therefore, it may be contemplated that exosomes containing nucleic acid-targeting system may be introduced to monocytes and lymphocytes of and autologously reintroduced into a human. Accordingly, delivery or administration according to the invention may be performed using plasma exosomes.

Liposomes

Delivery or administration according to the invention can be performed with liposomes. Liposomes are spherical vesicle structures composed of a uni- or multilamellar lipid bilayer surrounding internal aqueous compartments and a relatively impermeable outer lipophilic phospholipid bilayer. Liposomes have gained considerable attention as drug delivery carriers because they are biocompatible, non-toxic, can deliver both hydrophilic and lipophilic drug molecules, protect their cargo from degradation by plasma enzymes, and transport their load across biological membranes and the blood brain barrier (BBB) (see, e.g., Spuch and Navarro, Journal of Drug Delivery, vol. 2011, Article ID 469679, 12 pages, 2011. doi:10.1155/2011/469679 for review). Liposomes can be made from several different types of lipids; however, phospholipids are most commonly used to generate liposomes as drug carriers. Although liposome formation is spontaneous when a lipid film is mixed with an aqueous solution, it can also be expedited by applying force in the form of shaking by using a homogenizer, sonicator, or an extrusion apparatus (see, e.g., Spuch and Navarro, Journal of Drug Delivery, vol. 2011, Article ID 469679, 12 pages, 2011. doi:10.1155/2011/469679 for review).

Several other additives may be added to liposomes in order to modify their structure and properties. For instance, either cholesterol or sphingomyelin may be added to the liposomal mixture in order to help stabilize the liposomal structure and to prevent the leakage of the liposomal inner cargo. Further, liposomes are prepared from hydrogenated egg phosphatidylcholine or egg phosphatidylcholine, cholesterol, and dicetyl phosphate, and their mean vesicle sizes were adjusted to about 50 and 100 nm. (see, e.g., Spuch and Navarro, Journal of Drug Delivery, vol. 2011, Article ID 469679, 12 pages, 2011. doi:10.1155/2011/469679 for review). A liposome formulation may be mainly comprised of natural phospholipids and lipids such as 1,2-distearoryl-sn-glycero-3-phosphatidyl choline (DSPC), sphingomyelin, egg phosphatidylcholines and monosialoganglioside. Since this formulation is made up of phospholipids only, liposomal formulations have encountered many challenges, one of the ones being the instability in plasma. Several attempts to overcome these challenges have been made, specifically in the manipulation of the lipid membrane. One of these attempts focused on the manipulation of cholesterol. Addition of cholesterol to conventional formulations reduces rapid release of the encapsulated bioactive compound into the plasma or 1,2-dioleoyl-sn-glycero-3-phosphoethanolamine (DOPE) increases the stability (see, e.g., Spuch and Navarro, Journal of Drug Delivery, vol. 2011, Article ID 469679, 12 pages, 2011. doi:10.1155/2011/469679 for review). In a particularly advantageous embodiment, Trojan Horse liposomes (also known as Molecular Trojan Horses) are desirable and protocols may be found at cshprotocols.cshlp.org/content/2010/4/pdb.prot5407.long. These particles allow delivery of a transgene to the entire brain after an intravascular injection. Without being bound by limitation, it is believed that neutral lipid particles with specific antibodies conjugated to surface allow crossing of the blood brain barrier via endocytosis. Applicant postulates utilizing Trojan Horse Liposomes to deliver the CRISPR-Cas complexes to the brain via an intravascular injection, which would allow whole brain transgenic animals without the need for embryonic manipulation. About 1-5 g of DNA or RNA may be contemplated for in vivo administration in liposomes.

In another embodiment, the nucleic acid-targeting system or components thereof may be administered in liposomes, such as a stable nucleic-acid-lipid particle (SNALP) (see, e.g., Morrissey et al., Nature Biotechnology, Vol. 23, No. 8, August 2005). Daily intravenous injections of about 1, 3 or 5 mg/kg/day of a specific nucleic acid-targeting system targeted in a SNALP are contemplated. The daily treatment may be over about three days and then weekly for about five weeks. In another embodiment, a specific nucleic acid-targeting system encapsulated SNALP) administered by intravenous injection to at doses of about 1 or 2.5 mg/kg are also contemplated (see, e.g., Zimmerman et al., Nature Letters, Vol. 441, 4 May 2006). The SNALP formulation may contain the lipids 3-N-[(wmethoxypoly(ethylene glycol) 2000) carbamoyl]-1,2-dimyristyloxy-propylamine (PEG-C-DMA), 1,2-dilinoleyloxy-N,N-dimethyl-3-aminopropane (DLinDMA), 1,2-distearoyl-sn-glycero-3-phosphocholine (DSPC) and cholesterol, in a 2:40:10:48 molar percent ratio (see, e.g., Zimmerman et al., Nature Letters, Vol. 441, 4 May 2006). In another embodiment, stable nucleic-acid-lipid particles (SNALPs) have proven to be effective delivery molecules to highly vascularized HepG2-derived liver tumors but not in poorly vascularized HCT-116 derived liver tumors (see, e.g., Li, Gene Therapy (2012) 19, 775-780). The SNALP liposomes may be prepared by formulating D-Lin-DMA and PEG-C-DMA with distearoylphosphatidylcholine (DSPC), Cholesterol and siRNA using a 25:1 lipid/siRNA ratio and a 48/40/10/2 molar ratio of Cholesterol/D-Lin-DMA/DSPC/PEG-C-DMA. The resulted SNALP liposomes are about 80-100 nm in size. In yet another embodiment, a SNALP may comprise synthetic cholesterol (Sigma-Aldrich, St Louis, MO, USA), dipalmitoylphosphatidylcholine (Avanti Polar Lipids, Alabaster, AL, USA), 3-N-[(w-methoxy poly(ethylene glycol)2000) carbamoyl]-1,2-dimyrestyloxypropylamine, and cationic 1,2-dilinoleyloxy-3-N,Ndimethylaminopropane (see, e.g., Geisbert et al., Lancet 2010; 375: 1896-905). A dosage of about 2 mg/kg total nucleic acid-targeting systemper dose administered as, for example, a bolus intravenous infusion may be contemplated. In yet another embodiment, a SNALP may comprise synthetic cholesterol (Sigma-Aldrich), 1,2-distearoyl-sn-glycero-3-phosphocholine (DSPC; Avanti Polar Lipids Inc.), PEG-cDMA, and 1,2-dilinoleyloxy-3-(N;N-dimethyl)aminopropane (DLinDMA) (see, e.g., Judge, J. Clin. Invest. 119:661-673 (2009)). Formulations used for in vivo studies may comprise a final lipid/RNA mass ratio of about 9:1.

The safety profile of RNAi nanomedicines has been reviewed by Barros and Gollob of Alnylam Pharmaceuticals (see, e.g., Advanced Drug Delivery Reviews 64 (2012) 1730-1737). The stable nucleic acid lipid particle (SNALP) is comprised of four different lipids—an ionizable lipid (DLinDMA) that is cationic at low pH, a neutral helper lipid, cholesterol, and a diffusible polyethylene glycol (PEG)- lipid. The particle is approximately 80 nm in diameter and is charge-neutral at physiologic pH. During formulation, the ionizable lipid serves to condense lipid with the anionic RNA during particle formation. When positively charged under increasingly acidic endosomal conditions, the ionizable lipid also mediates the fusion of SNALP with the endosomal membrane enabling release of RNA into the cytoplasm. The PEG-lipid stabilizes the particle and reduces aggregation during formulation, and subsequently provides a neutral hydrophilic exterior that improves pharmacokinetic properties. To date, two clinical programs have been initiated using SNALP formulations with RNA. Tekmira Pharmaceuticals recently completed a phase I single-dose study of SNALP-ApoB in adult volunteers with elevated LDL cholesterol. ApoB is predominantly expressed in the liver and jejunum and is essential for the assembly and secretion of VLDL and LDL. Seventeen subjects received a single dose of SNALP-ApoB (dose escalation across 7 dose levels). There was no evidence of liver toxicity (anticipated as the potential dose-limiting toxicity based on preclinical studies). One (of two) subjects at the highest dose experienced flu-like symptoms consistent with immune system stimulation, and the decision was made to conclude the trial. Alnylam Pharmaceuticals has similarly advanced ALN-TTR01, which employs the SNALP technology described above and targets hepatocyte production of both mutant and wild-type TTR to treat TTR amyloidosis (ATTR). Three ATTR syndromes have been described: familial amyloidotic polyneuropathy (FAP) and familial amyloidotic cardiomyopathy (FAC)—both caused by autosomal dominant mutations in TTR; and senile systemic amyloidosis (SSA) cause by wildtype TTR. A placebo-controlled, single dose-escalation phase I trial of ALN-TTR01 was recently completed in patients with ATTR. ALN-TTR01 was administered as a 15-minute IV infusion to 31 patients (23 with study drug and 8 with placebo) within a dose range of 0.01 to 1.0 mg/kg (based on siRNA). Treatment was well tolerated with no significant increases in liver function tests. Infusion-related reactions were noted in 3 of 23 patients at ≥0.4 mg/kg; all responded to slowing of the infusion rate and all continued on study. Minimal and transient elevations of serum cytokines IL-6, IP-10 and IL-1ra were noted in two patients at the highest dose of 1 mg/kg (as anticipated from preclinical and NHP studies). Lowering of serum TTR, the expected pharmacodynamics effect of ALN-TTR01, was observed at 1 mg/kg.

In yet another embodiment, a SNALP may be made by solubilizing a cationic lipid, DSPC, cholesterol and PEG-lipid e.g., in ethanol, e.g., at a molar ratio of 40:10:40:10, respectively (see, Semple et al., Nature Niotechnology, Volume 28 Number 2 Feb. 2010, pp. 172-177). The lipid mixture was added to an aqueous buffer (50 mM citrate, pH 4) with mixing to a final ethanol and lipid concentration of 30% (vol/vol) and 6.1 mg/ml, respectively, and allowed to equilibrate at 22° C. for 2 min before extrusion. The hydrated lipids were extruded through two stacked 80 nm pore-sized filters (Nuclepore) at 22° C. using a Lipex Extruder (Northern Lipids) until a vesicle diameter of 70-90 nm, as determined by dynamic light scattering analysis, was obtained. This generally required 1-3 passes. The siRNA (solubilized in a 50 mM citrate, pH 4 aqueous solution containing 30% ethanol) was added to the pre-equilibrated (35° C.) vesicles at a rate of ~5 ml/min with mixing. After a final target siRNA/lipid ratio of 0.06 (wt/wt) was reached, the mixture was incubated for a further 30 min at 35° C. to allow vesicle reorganization and encapsulation of the siRNA. The ethanol was then removed and the external buffer replaced with PBS (155 mM NaCl, 3 mM Na2HPO4, 1 mM KH2PO4, pH 7.5) by either dialysis or tangential flow diafiltration. siRNA were encapsulated in SNALP using a controlled step-wise dilution method process. The lipid constituents of KC2-SNALP were DLin-KC2-DMA (cationic lipid), dipalmitoylphosphatidylcholine (DPPC; Avanti Polar Lipids), synthetic cholesterol (Sigma) and PEG-C-DMA used at a molar ratio of 57.1:7.1:34.3:1.4. Upon formation of the loaded particles, SNALP were dialyzed against PBS and filter sterilized through a 0.2 m filter before use. Mean particle sizes were 75-85 nm and 90-95% of the siRNA was encapsulated within the lipid particles. The final siRNA/lipid ratio in formulations used for in vivo testing was ~0.15 (wt/wt). LNP-siRNA systems containing Factor VII siRNA were diluted to the appropriate concentrations in sterile PBS immediately before use and the formulations were administered intravenously through the lateral tail vein in a total volume of 10 ml/kg. This method and these delivery systems may be extrapolated to the nucleic acid-targeting system of the present invention.

Other Lipids

Other cationic lipids, such as amino lipid 2,2-dilinoleyl-4-dimethylaminoethyl-[1,3]-dioxolane (DLin-KC2-DMA) may be utilized to encapsulate nucleic acid-targeting system or components thereof or nucleic acid molecule(s) coding therefor e.g., similar to SiRNA (see, e.g., Jayaraman, Angew. Chem. Int. Ed. 2012, 51, 8529-8533), and hence may be employed in the practice of the invention. A preformed vesicle with the following lipid composition may be contemplated: amino lipid, distearoylphosphatidylcholine (DSPC), cholesterol and (R)-2,3-bis(octadecyloxy) propyl-1-(methoxy poly(ethylene glycol)2000)propylcarbamate (PEG-lipid) in the molar ratio 40/10/40/10, respectively, and a FVII siRNA/total lipid ratio of approximately 0.05 (w/w). To ensure a narrow particle size distribution in the range of 70-90 nm and a low polydispersity index of 0.11±0.04 (n=56), the particles may be extruded up to three times through 80 nm membranes prior to adding the guide RNA. Particles containing the highly potent amino lipid 16 may be used, in which the molar ratio of the four lipid components 16, DSPC, cholesterol and PEG-lipid (50/10/38.5/1.5) which may be further optimized to enhance in vivo activity.

Michael S D Kormann et al. ("Expression of therapeutic proteins after delivery of chemically modified mRNA in mice: Nature Biotechnology, Volume:29, Pages: 154-157 (2011)) describes the use of lipid envelopes to deliver RNA. Use of lipid envelopes is also preferred in the present invention.

In another embodiment, lipids may be formulated with the RNA-targeting system (CRISPR-Cas13 complex, i.e., the Cas13 complexed with crRNA) of the present invention or component(s) thereof or nucleic acid molecule(s) coding therefor to form lipid nanoparticles (LNPs). Lipids include, but are not limited to, DLin-KC2-DMA4, C12-200 and colipids disteroylphosphatidyl choline, cholesterol, and PEG-DMG may be formulated with RNA-targeting system instead of siRNA (see, e.g., Novobrantseva, Molecular Therapy-Nucleic Acids (2012) 1, e4; doi:10.1038/mtna.2011.3) using a spontaneous vesicle formation procedure. The component molar ratio may be about 50/10/38.5/1.5 (DLin-KC2-DMA or C12-200/disteroylphosphatidyl choline/cholesterol/PEG-DMG). The final lipid:siRNA weight ratio may be ~12:1 and 9:1 in the case of DLin-KC2-DMA and C12-200 lipid particles (LNPs), respectively. The formulations may have mean particle diameters of ~80 nm with >90% entrapment efficiency. A 3 mg/kg dose may be contemplated. Tekmira has a portfolio of approximately 95 patent families, in the U.S. and abroad, that are directed to various aspects of LNPs and LNP formulations (see, e.g., U.S. Pat. Nos. 7,982,027; 7,799,565; 8,058,069; 8,283,333; 7,901,708; 7,745,651; 7,803,397; 8,101,741; 8,188,263; 7,915,399; 8,236,943 and 7,838,658 and European Pat. Nos 1766035; 1519714; 1781593 and 1664316), all of which may be used and/or adapted to the present invention.

The RNA-targeting system or components thereof or nucleic acid molecule(s) coding therefor may be delivered encapsulated in PLGA Microspheres such as that further described in US published applications 20130252281 and 20130245107 and 20130244279 (assigned to Moderna Therapeutics) which relate to aspects of formulation of compositions comprising modified nucleic acid molecules which may encode a protein, a protein precursor, or a partially or fully processed form of the protein or a protein precursor. The formulation may have a molar ratio 50:10: 38.5:1.5-3.0 (cationic lipid:fusogenic lipid:cholesterol:PEG lipid). The PEG lipid may be selected from, but is not limited to PEG-c-DOMG, PEG-DMG. The fusogenic lipid may be DSPC. See also, Schrum et al., Delivery and Formulation of Engineered Nucleic Acids, US published application 20120251618.

Nanomerics' technology addresses bioavailability challenges for a broad range of therapeutics, including low molecular weight hydrophobic drugs, peptides, and nucleic acid based therapeutics (plasmid, siRNA, miRNA). Specific administration routes for which the technology has demonstrated clear advantages include the oral route, transport across the blood-brain-barrier, delivery to solid tumours, as well as to the eye. See, e.g., Mazza et al., 2013, ACS Nano. 2013 Feb. 26; 7(2):1016-26; Uchegbu and Siew, 2013, J Pharm Sci. 102(2):305-10 and Lalatsa et al., 2012, J Control Release. 2012 Jul. 20; 161(2):523-36.

US Patent Publication No. 20050019923 describes cationic dendrimers for delivering bioactive molecules, such as polynucleotide molecules, peptides and polypeptides and/or pharmaceutical agents, to a mammalian body. The dendrimers are suitable for targeting the delivery of the bioactive molecules to, for example, the liver, spleen, lung, kidney or heart (or even the brain). Dendrimers are synthetic 3-dimensional macromolecules that are prepared in a step-wise fashion from simple branched monomer units, the nature and functionality of which can be easily controlled and varied. Dendrimers are synthesized from the repeated addition of building blocks to a multifunctional core (divergent approach to synthesis), or towards a multifunctional core (convergent approach to synthesis) and each addition of a 3-dimensional shell of building blocks leads to the formation of a higher generation of the dendrimers. Polypropylenimine dendrimers start from a diaminobutane core to which is added twice the number of amino groups by a double Michael addition of acrylonitrile to the primary amines followed by the hydrogenation of the nitriles. This results in a doubling of the amino groups. Polypropylenimine dendrimers contain 100% protonable nitrogens and up to 64 terminal amino groups (generation 5, DAB 64). Protonable groups are usually amine groups which are able to accept protons at neutral pH. The use of dendrimers as gene delivery agents has largely focused on the use of the polyamidoamine. and phosphorous containing compounds with a mixture of amine/amide or N—P($O_2$)S as the conjugating units respectively with no work being reported on the use of the lower generation polypropylenimine dendrimers for gene delivery. Polypropylenimine dendrimers have also been studied as pH sensitive controlled release systems for drug delivery and for their encapsulation of guest molecules when chemically modified by peripheral amino acid groups. The cytotoxicity and interaction of polypropylenimine dendrimers with DNA as well as the transfection efficacy of DAB 64 has also been studied. US Patent Publication No. 20050019923 is based upon the observation that, contrary to earlier reports, cationic dendrimers, such as polypropylenimine dendrimers, display suitable properties, such as specific targeting and low toxicity, for use in the targeted delivery of bioactive molecules, such as genetic material. In addition, derivatives of the cationic dendrimer also display suitable properties for the targeted delivery of bioactive molecules. See also, Bioactive Polymers, US published application 20080267903, which discloses "Various polymers, including cationic polyamine polymers and dendrimeric polymers, are shown to possess anti-proliferative activity, and may therefore be useful for treatment of disorders characterised by undesirable cellular proliferation such as neoplasms and tumours, inflammatory disorders (including autoimmune disorders), psoriasis and atherosclerosis. The polymers may be used alone as active agents, or as delivery vehicles for other therapeutic agents, such as drug molecules or nucleic acids for gene therapy. In such cases, the polymers' own intrinsic anti-tumour activity may complement the activity of the agent to be delivered." The disclosures of these patent publications may be employed in conjunction with herein teachings for delivery of nucleic acid-targeting system(s) or component(s) thereof or nucleic acid molecule(s) coding therefor.

Supercharged Proteins

Supercharged proteins are a class of engineered or naturally occurring proteins with unusually high positive or negative net theoretical charge and may be employed in delivery of nucleic acid-targeting system(s) or component(s) thereof or nucleic acid molecule(s) coding therefor. Both supernegatively and superpositively charged proteins exhibit a remarkable ability to withstand thermally or chemically induced aggregation. Superpositively charged proteins are also able to penetrate mammalian cells. Associating cargo with these proteins, such as plasmid DNA, RNA, or other proteins, can enable the functional delivery of these macromolecules into mammalian cells both in vitro and in vivo. David Liu's lab reported the creation and characterization of supercharged proteins in 2007 (Lawrence et al., 2007, Journal of the American Chemical Society 129, 10110-10112).

The nonviral delivery of RNA and plasmid DNA into mammalian cells are valuable both for research and therapeutic applications (Akinc et al., 2010, Nat. Biotech. 26, 561-569). Purified +36 GFP protein (or other superpositively charged protein) is mixed with RNAs in the appropriate serum-free media and allowed to complex prior addition to cells. Inclusion of serum at this stage inhibits formation of the supercharged protein-RNA complexes and reduces the effectiveness of the treatment. The following protocol has been found to be effective for a variety of cell lines (McNaughton et al., 2009, Proc. Natl. Acad. Sci. USA 106, 6111-6116). However, pilot experiments varying the dose of protein and RNA should be performed to optimize the procedure for specific cell lines. (1) One day before treatment, plate $1\times10^5$ cells per well in a 48-well plate. (2) On the day of treatment, dilute purified +36 GFP protein in serumfree media to a final concentration 200 nM. Add RNA to a final concentration of 50 nM. Vortex to mix and incubate at room temperature for 10 min. (3) During incubation, aspirate media from cells and wash once with PBS. (4) Following incubation of +36 GFP and RNA, add the protein- RNA complexes to cells. (5) Incubate cells with complexes at 37° C. for 4 h. (6) Following incubation, aspirate the media and wash three times with 20 U/mL heparin PBS. Incubate cells with serum-containing media for a further 48 h or longer depending upon the assay for activity. (7) Analyze cells by immunoblot, qPCR, phenotypic assay, or other appropriate method.

+36 GFP was found to be an effective plasmid delivery reagent in a range of cells. See also, e.g., McNaughton et al., Proc. Natl. Acad. Sci. USA 106, 6111-6116 (2009); Cronican et al., ACS Chemical Biology 5, 747-752 (2010); Cronican et al., Chemistry & Biology 18, 833-838 (2011); Thompson et al., Methods in Enzymology 503, 293-319 (2012); Thompson, D. B., et al., Chemistry & Biology 19 (7), 831-843 (2012). The methods of the super charged proteins may be used and/or adapted for delivery of the RNA-targeting system(s) or component(s) thereof or nucleic acid molecule(s) coding therefor of the invention.

Cell Penetrating Peptides (CPPs)

In yet another embodiment, cell penetrating peptides (CPPs) are contemplated for the delivery of the CRISPR Cas system. CPPs are short peptides that facilitate cellular uptake of various molecular cargo (from nanosize particles to small chemical molecules and large fragments of DNA). The term "cargo" as used herein includes but is not limited to the group consisting of therapeutic agents, diagnostic probes, peptides, nucleic acids, antisense oligonucleotides, plasmids, proteins, particles including nanoparticles, liposomes, chromophores, small molecules and radioactive materials. In aspects of the invention, the cargo may also comprise any component of the CRISPR Cas system or the entire functional CRISPR Cas system. Aspects of the present invention further provide methods for delivering a desired cargo into a subject comprising: (a) preparing a complex comprising the cell penetrating peptide of the present invention and a desired cargo, and (b) orally, intraarticularly, intraperitoneally, intrathecally, intraarterially, intranasally, intraparenchymal, subcutaneously, intramuscularly, intravenously, dermally, intrarectally, or topically administering the complex to a subject. The cargo is associated with the peptides either through chemical linkage via covalent bonds or through non-covalent interactions. The function of the CPPs are to deliver the cargo into cells, a process that commonly occurs through endocytosis with the cargo delivered to the endosomes of living mammalian cells. Cell-penetrating peptides are of different sizes, amino acid sequences, and charges but all CPPs have one distinct characteristic, which is the ability to translocate the plasma membrane and facilitate the delivery of various molecular cargoes to the cytoplasm or an organelle. CPP translocation may be classified into three main entry mechanisms: direct penetration in the membrane, endocytosis-mediated entry, and translocation through the formation of a transitory structure. CPPs have found numerous applications in medicine as drug delivery agents in the treatment of different diseases including cancer and virus inhibitors, as well as contrast agents for cell labeling. Examples of the latter include acting as a carrier for GFP, MRI contrast agents, or quantum dots. CPPs hold great potential as in vitro and in vivo delivery vectors for use in research and medicine. CPPs typically have an amino acid composition that either contains a high relative abundance of positively charged amino acids such as lysine or arginine or has sequences that contain an alternating pattern of polar/charged amino acids and non-polar, hydrophobic amino acids. These two types of structures are referred to as polycationic or amphipathic, respectively. A third class of CPPs are the hydrophobic peptides, containing only apolar residues, with low net charge or have hydrophobic amino acid groups that are crucial for cellular uptake. One of the initial CPPs discovered was the trans-activating transcriptional activator (Tat) from Human Immunodeficiency Virus 1 (HIV-1) which was found to be efficiently taken up from the surrounding media by numerous cell types in culture. Since then, the number of known CPPs has expanded considerably and small molecule synthetic analogues with more effective protein transduction properties have been generated. CPPs include but are not limited to Penetratin, Tat (48-60), Transportan, and (R-AhX-R4) (Ahx=aminohexanoyl).

U.S. Pat. No. 8,372,951, provides a CPP derived from eosinophil cationic protein (ECP) which exhibits highly cell-penetrating efficiency and low toxicity. Aspects of delivering the CPP with its cargo into a vertebrate subject are also provided. Further aspects of CPPs and their delivery are described in U.S. Pat. Nos. 8,575,305; 8,614,194 and 8,044,019. CPPs can be used to deliver the CRISPR-Cas system or components thereof. That CPPs can be employed to deliver the CRISPR-Cas system or components thereof is also provided in the manuscript "Gene disruption by cell-penetrating peptide-mediated delivery of Cas9 protein and guide RNA", by Suresh Ramakrishna, Abu-Bonsrah Kwaku Dad, Jagadish Beloor, et al. Genome Res. 2014 Apr. 2. [Epub ahead of print], incorporated by reference in its entirety, wherein it is demonstrated that treatment with CPP-conjugated recombinant Cas9 protein and CPP-complexed guide RNAs lead to endogenous gene disruptions in human cell lines. In the paper the Cas9 protein was conjugated to CPP via a thioether bond, whereas the guide RNA was complexed with CPP, forming condensed, positively charged particles. It was shown that simultaneous and sequential treatment of human cells, including embryonic stem cells, dermal fibroblasts, HEK293T cells, HeLa cells, and embryonic carcinoma cells, with the modified Cas9 and guide RNA led to efficient gene disruptions with reduced off-target mutations relative to plasmid transfections. CPP delivery can be used in the practice of the invention.

Implantable Devices

In another embodiment, implantable devices are also contemplated for delivery of the RNA-targeting system or component(s) thereof or nucleic acid molecule(s) coding therefor. For example, US Patent Publication 20110195123 discloses an implantable medical device which elutes a drug locally and in prolonged period is provided, including several types of such a device, the treatment modes of implementation and methods of implantation. The device comprising of polymeric substrate, such as a matrix for example, that is used as the device body, and drugs, and in some cases additional scaffolding materials, such as metals or additional polymers, and materials to enhance visibility and imaging. An implantable delivery device can be advantageous in providing release locally and over a prolonged period, where drug is released directly to the extracellular matrix (ECM) of the diseased area such as tumor, inflammation, degeneration or for symptomatic objectives, or to injured smooth muscle cells, or for prevention. One kind of drug is RNA, as disclosed above, and this system may be used/and or adapted to the nucleic acid-targeting system of the present invention. The modes of implantation in some embodiments are existing implantation procedures that are developed and used today for other treatments, including brachytherapy and needle biopsy. In such cases the dimensions of the new implant described in this invention are similar to the original implant. Typically a few devices are implanted during the same treatment procedure. US Patent Publication 20110195123, provides a drug delivery implantable or insertable system, including systems applicable to a cavity such as the abdominal cavity and/or any other type of administration in which the drug delivery system is not anchored or attached, comprising a biostable and/or degradable and/or bioabsorbable polymeric substrate, which may for example optionally be a matrix. It should be noted that the term "insertion" also includes implantation. The drug delivery system is preferably implemented as a "Loder" as described in US Patent Publication 20110195123. The polymer or plurality of polymers are biocompatible, incorporating an agent and/or plurality of agents, enabling the release of agent at a controlled rate, wherein the total volume of the polymeric substrate, such as a matrix for example, in some embodiments is optionally and preferably no greater than a maximum volume that permits a therapeutic level of the agent to be reached. As a non-limiting example, such a volume is preferably within the range of 0.1 $m^3$ to 1000 $mm^3$, as required by the volume for the agent load. The Loder may optionally be larger, for example when incorporated with a device whose size is determined by functionality, for example and without limitation, a knee joint, an intra-uterine or cervical ring and the like. The drug delivery system (for delivering the composition) is designed in some embodiments to preferably employ degradable polymers, wherein the main release mechanism is bulk erosion; or in some embodiments, non-degradable, or slowly degraded polymers are used, wherein the main release mechanism is diffusion rather than bulk erosion, so that the outer part functions as membrane, and its internal part functions as a drug reservoir, which practically is not affected by the surroundings for an extended period (for example from about a week to about a few months). Combinations of different polymers with different release mechanisms may also optionally be used. The concentration gradient at the surface is preferably maintained effectively constant during a significant period of the total drug releasing period, and therefore the diffusion rate is effectively constant (termed "zero mode" diffusion). By the term "constant" it is meant a diffusion rate that is preferably maintained above the lower threshold of therapeutic effectiveness, but which may still optionally feature an initial burst and/or may fluctuate, for example increasing and decreasing to a certain degree. The diffusion rate is preferably so maintained for a prolonged period, and it can be considered constant to a certain level to optimize the therapeutically effective period, for example the effective silencing period. The drug delivery system optionally and preferably is designed to shield the nucleotide based therapeutic agent from degradation, whether chemical in nature or due to attack from enzymes and other factors in the body of the subject. The drug delivery system of US Patent Publication 20110195123 is optionally associated with sensing and/or activation appliances that are operated at and/or after implantation of the device, by non and/or minimally invasive methods of activation and/or acceleration/deceleration, for example optionally including but not limited to thermal heating and cooling, laser beams, and ultrasonic, including focused ultrasound and/or RF (radiofrequency) methods or devices. According to some embodiments of US Patent Publication 20110195123, the site for local delivery may optionally include target sites characterized by high abnormal proliferation of cells, and suppressed apoptosis, including tumors, active and or chronic inflammation and infection including autoimmune diseases states, degenerating tissue including muscle and nervous tissue, chronic pain, degenerative sites, and location of bone fractures and other wound locations for enhancement of regeneration of tissue, and injured cardiac, smooth and striated muscle. The site for implantation of the composition, or target site, preferably features a radius, area and/or volume that is sufficiently small for targeted local delivery. For example, the target site optionally has a diameter in a range of from about 0.1 mm to about 5 cm. The location of the target site is preferably selected for maximum therapeutic efficacy. For example, the composition of the drug delivery system (optionally with a device for implantation as described above) is optionally and preferably implanted within or in the proximity of a tumor environment, or the blood supply associated thereof. For example the composition (optionally with the device) is optionally implanted within or in the proximity to pancreas, prostate, breast, liver, via the nipple, within the vascular system and so forth. The target location is optionally selected from the group comprising, consisting essentially of, or consisting of (as non-limiting examples only, as optionally any site within the body may be suitable for implanting a Loder): 1. brain at degenerative sites like in Parkinson or Alzheimer disease at the basal ganglia, white and gray matter; 2. spine as in the case of amyotrophic lateral sclerosis (ALS); 3. uterine cervix to prevent HPV infection; 4. active and chronic inflammatory joints; 5. dermis as in the case of psoriasis; 6. sympathetic and sensoric nervous sites for analgesic effect; 7. Intra osseous implantation; 8. acute and chronic infection sites; 9. Intra vaginal; 10. Inner ear—auditory system, labyrinth of the inner ear, vestibular system; 11. Intra tracheal; 12. Intra-cardiac; coronary, epicardiac; 13. urinary bladder; 14. biliary system; 15. parenchymal tissue including and not limited to the kidney, liver, spleen; 16. lymph nodes; 17. salivary glands; 18. dental gums; 19. Intra-articular (into joints); 20. Intra-ocular; 21. Brain tissue; 22. Brain ventricles; 23. Cavities, including abdominal cavity (for example but without limitation, for ovary cancer); 24. Intra esophageal and 25. Intra rectal.

Optionally insertion of the system (for example a device containing the composition) is associated with injection of material to the ECM at the target site and the vicinity of that site to affect local pH and/or temperature and/or other biological factors affecting the diffusion of the drug and/or drug kinetics in the ECM, of the target site and the vicinity of such a site. Optionally, according to some embodiments, the release of said agent could be associated with sensing and/or activation appliances that are operated prior and/or at and/or after insertion, by non and/or minimally invasive and/or else methods of activation and/or acceleration/deceleration, including laser beam, radiation, thermal heating and cooling, and ultrasonic, including focused ultrasound and/or RF (radiofrequency) methods or devices, and chemical activators.

According to embodiments of US Patent Publication 20110195123 that can be used in the practice of the invention, the drug preferably comprises a RNA, for example for localized cancer cases in breast, pancreas, brain, kidney, bladder, lung, and prostate as described below. Although exemplified with RNAi, many drugs are applicable to be encapsulated in Loder, and can be used in association with this invention, as long as such drugs can be encapsulated with the Loder substrate, such as a matrix for example, and this system may be used and/or adapted to deliver the nucleic acid-targeting system of the present invention. As another example of a specific application, neuro and muscular degenerative diseases develop due to abnormal gene expression. Local delivery of RNAs may have therapeutic properties for interfering with such abnormal gene expression. Local delivery of anti-apoptotic, anti-inflammatory and anti-degenerative drugs including small drugs and macromolecules may also optionally be therapeutic. In such cases the Loder is applied for prolonged release at constant rate and/or through a dedicated device that is implanted separately.

All of this may be used and/or adapted to the RNA-targeting system of the present invention. Implantable device technology herein discussed can be employed with herein teachings and hence by this disclosure and the knowledge in the art, CRISPR-Cas13 system or complex or components thereof or nucleic acid molecules thereof or encoding or providing components may be delivered via an implantable device.

Polymer-Based Particles

The systems and compositions herein may be delivered using polymer-based particles (e.g., nanoparticles). In some embodiments, the polymer-based particles may mimic a viral mechanism of membrane fusion. The polymer-based particles may be a synthetic copy of Influenza virus machinery and form transfection complexes with various types of nucleic acids ((siRNA, miRNA, plasmid DNA or shRNA, mRNA) that cells take up via the endocytosis pathway, a process that involves the formation of an acidic compartment. The low pH in late endosomes acts as a chemical switch that renders the particle surface hydrophobic and facilitates membrane crossing. Once into the cytosol, the particle releases its payload for cellular action. This Active Endosome Escape technology is safe and maximizes transfection efficiency as it is using a natural uptake pathway. In some embodiments, the polymer-based particles may comprise alkylated and carboxyalkylated branched polyethylenimine. In some examples, the polymer-based particles are VIROMER, e.g., VIROMER RNAi, VIROMER RED, VIROMER mRNA, VIROMER CRISPR. Example methods of delivering the systems and compositions herein include those described in Bawage S S et al., Synthetic mRNA expressed Cas13a mitigates RNA virus infections, www.biorxiv.org/content/10.1101/370460v1.full doi: doi.org/10.1101/370460, Viromer® RED, a powerful tool for transfection of keratinocytes. doi: 10.13140/RG.2.2.16993.61281, Viromer® Transfection—Factbook 2018: technology, product overview, users' data, doi: 10.13140/RG.2.2.23912.16642.

Vectors

In certain aspects the invention involves vectors, e.g. for delivering or introducing in a cell CRISPR-Cas and/or RNA capable of guiding CRISPR-Cas to a target locus (i.e. guide RNA), but also for propagating these components (e.g. in prokaryotic cells). A used herein, a "vector" is a tool that allows or facilitates the transfer of an entity from one environment to another. It is a replicon, such as a plasmid, phage, or cosmid, into which another DNA segment may be inserted so as to bring about the replication of the inserted segment. Generally, a vector is capable of replication when associated with the proper control elements. In general, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g. circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g. retroviruses, replication defective retroviruses, adenoviruses, replication defective adenoviruses, and adeno-associated viruses (AAVs)). Viral vectors also include polynucleotides carried by a virus for transfection into a host cell. Certain vectors are capable of autonomous replication in a host cell into which they are introduced (e.g. bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Common expression vectors of utility in recombinant DNA techniques are often in the form of plasmids.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g. in an in vitro transcription/translation system or in a host cell when the vector is introduced into the host cell). With regards to recombination and cloning methods, mention is made of U.S. patent application Ser. No. 10/815,730, published Sep. 2, 2004 as US 2004-0171156 A1, the contents of which are herein incorporated by reference in their entirety.

The vector(s) can include the regulatory element(s), e.g., promoter(s). The vector(s) can comprise CRISPR-Cas encoding sequence(s), and/or a single, but possibly also can comprise at least 2, 3 or 8 or 16 or 32 or 48 or 50 guide RNA(s) (e.g., crRNAs) encoding sequences, such as 1-2, 1-3, 1-4 1-5, 3-6, 3-7, 3-8, 3-9, 3-10, 3-8, 3-16, 3-30, 3-32, 3-48, 3-50 RNA(s) (e.g., crRNAs). In a single vector there can be a promoter for each RNA (e.g., crRNA(s)), advantageously when there are up to about 16 RNA(s) (e.g., crRNA(s)s); and, when a single vector provides for more than 16 RNA(s) (e.g., crRNA(s)s), one or more promoter(s) can drive expression of more than one of the RNA(s) (e.g., crRNA(s)s), e.g., when there are 32 RNA(s) (e.g., sgRNAs or crRNA(s)), each promoter can drive expression of two RNA(s) (e.g., sgRNAs or crRNA(s)), and when there are 48 RNA(s) (e.g., sgRNAs or crRNA(s)), each promoter can drive expression of three RNA(s) (e.g., sgRNAs or crRNA(s)). By simple arithmetic and well established cloning protocols and the teachings in this disclosure one skilled in the art can readily practice the invention as to the RNA(s), e.g., sgRNA(s) or crRNA(s) for a suitable exemplary vector such as AAV, and a suitable promoter such as the U6 promoter, e.g., U6-sgRNAs or -crRNA(s). For example, the packaging limit of AAV is ~4.7 kb. The skilled person can readily fit about 12-16, e.g., 13 U6-sgRNA or crRNA(s) cassettes in a single vector. This can be assembled by any suitable means, such as a golden gate strategy used for TALE assembly (www.genome-engineering.org/taleffectors/). The skilled person can also use a tandem guide strategy to increase the number of U6-sgRNAs or -crRNA(s) by approximately 1.5 times, e.g., to increase from 12-16, e.g., 13 to approximately 18-24, e.g., about 19 U6-sgRNAs or -crRNA(s). Therefore, one skilled in the art can readily reach approximately 18-24, e.g., about 19 promoter-RNAs, e.g., U6-sgRNAs or -crRNA(s) in a single vector, e.g., an AAV vector. A further means for increasing the number of promoters and RNAs, e.g., sgRNA(s) or crRNA(s) in a vector is to use a single promoter (e.g., U6) to express an array of RNAs, e.g., sgRNAs or crRNA(s) separated by cleavable sequences. And an even further means for increasing the number of promoter-RNAs, e.g., sgRNAs or crRNA(s) in a vector, is to express an array of promoter-RNAs, e.g., sgRNAs or crRNA(s) separated by cleavable sequences in the intron of a coding sequence or gene; and, in this instance it is advantageous to use a polymerase II promoter, which can have increased expression and enable the transcription of long RNA in a tissue specific manner. (see, e.g., nar.oxfordjoumals.org/content/34/7/e53.short, www.nature.com/mt/journal/v16/n9/abs/mt2008144a.html). In an advantageous embodiment, AAV may package U6 tandem sgRNA targeting up to about 50 genes. Accordingly, from the knowledge in the art and the teachings in this disclosure the skilled person can readily make and use vector(s), e.g., a single vector, expressing multiple RNAs or guides or sgRNAs or crRNA(s) under the control or operatively or functionally linked to one or more promoters-especially as to the numbers of RNAs or guides or sgRNAs or crRNA(s) discussed herein, without any undue experimentation.

Kits

In one aspect, the invention provides kits containing any one or more of the elements disclosed in the above methods and compositions. In some embodiments, the kit comprises a vector system as taught herein or one or more of the components of the CRISPR/Cas system or complex as taught herein, such as crRNAs and/or CRISPR-Cas effector protein or CRISPR-Cas effector protein encoding mRNA, and instructions for using the kit. Elements may be provide individually or in combinations, and may be provided in any suitable container, such as a vial, a bottle, or a tube. In some embodiments, the kit includes instructions in one or more languages, for example in more than one language. The instructions may be specific to the applications and methods described herein. In some embodiments, a kit comprises one or more reagents for use in a process utilizing one or more of the elements described herein. Reagents may be provided in any suitable container. For example, a kit may provide one or more reaction or storage buffers. Reagents may be provided in a form that is usable in a particular assay, or in a form that requires addition of one or more other components before use (e.g., in concentrate or lyophilized form). A buffer can be any buffer, including but not limited to a sodium carbonate buffer, a sodium bicarbonate buffer, a borate buffer, a Tris buffer, a MOPS buffer, a HEPES buffer, and combinations thereof. In some embodiments, the buffer is alkaline. In some embodiments, the buffer has a pH from about 7 to about 10. In some embodiments, the kit comprises one or more oligonucleotides corresponding to a guide sequence for insertion into a vector so as to operably link the guide or crRNA sequence and a regulatory element. In some embodiments, the kit comprises a homologous recombination template polynucleotide. In some embodiments, the kit comprises one or more of the vectors and/or one or more of the polynucleotides described herein. The kit may advantageously allow to provide all elements of the systems of the invention.

The present application also provides aspects and embodiments as set forth in the following numbered Statements:

1. An engineered CRISPR-Cas protein comprising one or more HEPN domains and further comprising one or more modified amino acids, wherein the amino acids: a) interact with a guide RNA that forms a complex with the engineered CRISPR-Cas protein; b) are in a HEPN active site, an inter-domain linker domain, a lid domain, a helical domain 1, a helical domain 2, or a bridge helix domain of the engineered CRISPR-Cas protein; or c) a combination thereof.
2. The engineered CRISPR-Cas protein of statement 1, wherein the HEPN domain comprises a RxxxxH motif.
3. The engineered CRISPR-Cas protein of statement 1 or 2, wherein the RxxxxH motif comprises a R{N/H/K}$X_1X_2X_3$H sequence.
4. The engineered CRISPR-Cas protein of any one of preceding statements, wherein: $X_1$ is R, S, D, E, Q, N, G, or Y; $X_2$ is independently I, S, T, V, or L; and $X_3$ is independently L, F, N, Y, V, I, S, D, E, or A.
5. The engineered CRISPR-Cas protein of any one of preceding statements, wherein the CRISPR-Cas protein is a Type VI CRISPR-Cas protein.
6. The engineered CRISPR-Cas protein of any one of preceding statements, wherein the Type VI CRISPR-Cas protein is Cas13.
7. The engineered CRISPR-Cas protein of any one of preceding statements, wherein the Type VI CRISPR-Cas protein is Cas13a, Cas13b, Cas13c, or Cas13d.
8. The engineered CRISPR-Cas protein of any one of preceding statements, comprising one or more mutation of an amino acid corresponding to the following amino acids of *Prevotella buccae* Cas13b (PbCas13b): T405, H407, K457, H500, K570, K590, N634, R638, N652, N653, K655, S658, K741, K744, N756, S757, R762, R791, K846, K857, K870, R877, K183, K193, R600, K607, K612, R614, K617, K826, K828, K829, R824, R830, Q831, K835, K836, R838, R618, D434, K431, R53, K943, R1041, Y164, R285, R287, K292, E296, N297, Q646, N647, R402, K393, N653, N652, R482, N480, D396, E397, D398, E399, K294, E400, R56, N157, H161, H452, N455, K484, N486, G566, H567, A656, V795, A796, W842, K871, E873, R874, R1068, N1069, or H1073.
9. The engineered CRISPR-Cas protein of any one of preceding statements, comprising one or more mutation of an amino acid corresponding to the following amino acids of *Prevotella buccae* Cas13b (PbCas13b): H407, K457, H500, K570, K590, N634, R638, N652, N653, K655, S658, K741, K744, N756, S757, R762, R791, K846, K857, K870, R877, K183, K193, R600, K607, K612, R614, K617, K826, K828, K829, R824, R830, Q831, K835, K836, R838, R618, D434, K431, R53, K943, R1041, Y164, R285, R287, K292, E296, N297, Q646, N647, R402, K393, N653, N652, R482, N480, D396, E397, D398, E399, K294, E400, R56, N157, H161, H452, N455, K484, N486, G566, H567, W842, K871, E873, R874, R1068, N1069, or H1073.
10. The engineered CRISPR-Cas protein of any one of preceding statements comprising one or more mutation of an amino acid corresponding to the following amino acids of *Prevotella buccae* Cas13b (PbCas13b): T405, H407, K457, H500, K570, K590, N634, R638, N652, N653, K655, S658, K741, K744, N756, S757, R762, R791, K846, K857, K870, R877, K183, K193, R600, K607, K612, R614, K617, K826, K828, K829, R824, R830, Q831, K835, K836, R838, R618, D434, K431, R53, K943, R1041, Y164, R285, R287, K292, E296, N297, Q646, N647, R402, K393, N653, N652, R482, N480, D396, E397, D398, E399, K294, or E400.

11. The engineered CRISPR-Cas protein of any one of preceding statements comprising one or more mutation of an amino acid corresponding to the following amino acids of *Prevotella buccae* Cas13b (PbCas13b): K393, R402, N482, T405, H407, S658, N653, A656, K655, N652, H567, N455, H500, K871, K857, K870, W842, E873, R877, K846, R874, R762, V795, A796, R791, G566, K590, R638, H452, S757, N756, N486, K484, N480, K457, K741, R56, N157, H161, R1068, N1069, or H1073.

12. The engineered CRISPR-Cas protein of any one of preceding statements comprising one or more mutation of an amino acid corresponding to the following amino acids of PbCas13b: K393, R402, N482, H407, S658, N653, K655, N652, H567, N455, H500, K871, K857, K870, W842, E873, R877, K846, R874, R762, R791, G566, K590, R638, H452, S757, N756, N486, K484, N480, K457, K741, R56, N157, H161, R1068, N1069, or H1073.

13. The engineered CRISPR-Cas protein of any one of preceding statements comprising one or more mutation of an amino acid corresponding to the following amino acids of PbCas13b: W842, K846, K870, E873, or R877.

14. The engineered CRISPR-Cas protein of any one of preceding statements comprising in helical domain 1 one or more mutation of an amino acid corresponding to the following amino acids in helical domain 1 of PbCas13b: W842, K846, K870, E873, or R877.

15. The engineered CRISPR-Cas protein of any one of preceding statements comprising in helical domain 1-3 one or more mutation of an amino acid corresponding to the following amino acids in helical domain 1-3 of PbCas13b: W842, K846, K870, E873, or R877.

16. The engineered CRISPR-Cas protein of any one of preceding statements comprising in the bridge helix domain one or more mutation of an amino acid corresponding to the following amino acids in the bridge helix domain of PbCas13b: W842, K846, K870, E873, or R877.

17. The engineered CRISPR-Cas protein of any one of preceding statements comprising one or more mutation of an amino acid corresponding to the following amino acids of PbCas13b: K393, R402, N480, N482, N652, or N653.

18. The engineered CRISPR-Cas protein of any one of preceding statements comprising one or more mutation of an amino acid corresponding to the following amino acids of PbCas13b: K393, R402, N480, or N482.

19. The engineered CRISPR-Cas protein of any one of preceding statements comprising in the LID domain one or more mutation of an amino acid corresponding to the following amino acids in the LID domain of PbCas13b: K393, R402, N480, or N482.

20. The engineered CRISPR-Cas protein of any one of preceding statements comprising one or more mutation of an amino acid corresponding to the following amino acids of PbCas13b: N652 or N653.

21. The engineered CRISPR-Cas protein of any one of preceding statements comprising in helical domain 2 one or more mutation of an amino acid corresponding to the following amino acids in helical domain 2 of PbCas13b: N652 or N653.

22. The engineered CRISPR-Cas protein of any one of preceding statements comprising one or more mutation of an amino acid corresponding to the following amino acids of PbCas13b: T405, H407, S658, N653, A656, K655, N652, H567, N455, H500, K871, K857, K870, W842, E873, R877, K846, R874, R762, V795, A796, R791, G566, K590, R638, H452, S757, N756, N486, K484, N480, K457, or K741.

23. The engineered CRISPR-Cas protein of any one of preceding statements comprising one or more mutation of an amino acid corresponding to the following amino acids of PbCas13b: H407, S658, N653, K655, N652, H567, N455, H500, K871, K857, K870, W842, E873, R877, K846, R874, R762, R791, G566, K590, R638, H452, S757, N756, N486, K484, N480, K457, or K741.

24. The engineered CRISPR-Cas protein of any one of preceding statements comprising one or more mutation of an amino acid corresponding to the following amino acids of PbCas13b: S658, N653, A656, K655, N652, H567, H500, K871, K857, K870, W842, E873, R877, K846, R874, R762, V795, A796, R791, G566, K590, R638, S757, N756, or K741.

25. The engineered CRISPR-Cas protein of any one of preceding statements comprising in a helical domain one or more mutation of an amino acid corresponding to the following amino acids in a helical domain of PbCas13b: S658, N653, A656, K655, N652, H567, H500, K871, K857, K870, W842, E873, R877, K846, R874, R762, V795, A796, R791, G566, K590, R638, S757, N756, or K741.

26. The engineered CRISPR-Cas protein of any one of preceding statements comprising one or more mutation of an amino acid corresponding to the following amino acids of PbCas13b: H567, H500, K871, K857, K870, W842, E873, R877, K846, R874, R762, V795, A796, R791, G566, S757, or N756.

27. The engineered CRISPR-Cas protein of any one of preceding statements comprising in helical domain 1 one or more mutation of an amino acid corresponding to the following amino acids in helical domain 1 of PbCas13b: H567, H500, K871, K857, K870, W842, E873, R877, K846, R874, R762, V795, A796, R791, G566, S757, or N756.

28. The engineered CRISPR-Cas protein of any one of preceding statements comprising one or more mutation of an amino acid corresponding to the following amino acids of PbCas13b: H567, H500, R762, V795, A796, R791, G566, S757, or N756.

29. The engineered CRISPR-Cas protein of any one of preceding statements comprising in helical domain 1 one or more mutation of an amino acid corresponding to the following amino acids in helical domain 1 of PbCas13b: H567, H500, R762, V795, A796, R791, G566, S757, or N756.

30. The engineered CRISPR-Cas protein of any one of preceding statements comprising one or more mutation of an amino acid corresponding to the following amino acids of PbCas13b: K871, K857, K870, W842, E873, R877, K846, or R874.

31. The engineered CRISPR-Cas protein of any one of preceding statements comprising in the bridge helix domain one or more mutation of an amino acid corresponding to the following amino acids in the bridge helix domain of PbCas13b: K871, K857, K870, W842, E873, R877, K846, or R874.

32. The engineered CRISPR-Cas protein of any one of preceding statements comprising one or more mutation of an amino acid corresponding to the following amino acids of PbCas13b: H567, H500, or G566.

33. The engineered CRISPR-Cas protein of any one of preceding statements comprising in helical domain 1-2 one or more mutation of an amino acid corresponding to the following amino acids in helical domain 1-2 of PbCas13b: H567, H500, or G566.
34. The engineered CRISPR-Cas protein of any one of preceding statements comprising one or more mutation of an amino acid corresponding to the following amino acids of PbCas13b: K871, K857, K870, W842, E873, R877, K846, R874, R762, V795, A796, R791, S757, or N756.
35. The engineered CRISPR-Cas protein of any one of preceding statements comprising in helical domain 1-3 one or more mutation of an amino acid corresponding to the following amino acids in helical domain 1-3 of PbCas13b: K871, K857, K870, W842, E873, R877, K846, R874, R762, V795, A796, R791, S757, or N756.
36. The engineered CRISPR-Cas protein of any one of preceding statements comprising one or more mutation of an amino acid corresponding to the following amino acids of PbCas13b: R762, V795, A796, R791, S757, or N756.
37. The engineered CRISPR-Cas protein of any one of preceding statements comprising in helical domain 1-3 one or more mutation of an amino acid corresponding to the following amino acids in helical domain 1-3 of PbCas13b: R762, V795, A796, R791, S757, or N756.
38. The engineered CRISPR-Cas protein of any one of preceding statements comprising one or more mutation of an amino acid corresponding to the following amino acids of PbCas13b: S658, N653, A656, K655, N652, K590, R638, or K741.
39. The engineered CRISPR-Cas protein of any one of preceding statements comprising in helical domain 2 one or more mutation of an amino acid corresponding to the following amino acids in helical domain 2 of PbCas13b: S658, N653, A656, K655, N652, K590, R638, or K741.
40. The engineered CRISPR-Cas protein of any one of preceding statements comprising one or more mutation of an amino acid corresponding to the following amino acids of PbCas13b: T405, H407, N486, K484, N480, H452, N455, or K457.
41. The engineered CRISPR-Cas protein of any one of preceding statements comprising in the LID domain one or more mutation of an amino acid corresponding to the following amino acids in the LID domain of PbCas13b: T405, H407, N486, K484, N480, H452, N455, or K457.
42. The engineered CRISPR-Cas protein of any one of preceding statements comprising one or more mutation of an amino acid corresponding to the following amino acids of PbCas13b: S658, N653, K655, N652, H567, H500, K871, K857, K870, W842, E873, R877, K846, R874, R762, R791, G566, K590, R638, S757, N756, or K741.
43. The engineered CRISPR-Cas protein of any one of preceding statements comprising in a helical domain one or more mutation of an amino acid corresponding to the following amino acids in a helical domain of PbCas13b: S658, N653, K655, N652, H567, H500, K871, K857, K870, W842, E873, R877, K846, R874, R762, R791, G566, K590, R638, S757, N756, or K741.
44. The engineered CRISPR-Cas protein of any one of preceding statements comprising one or more mutation of an amino acid corresponding to the following amino acids of PbCas13b: H567, H500, K871, K857, K870, W842, E873, R877, K846, R874, R762, R791, G566, S757, or N756.
45. The engineered CRISPR-Cas protein of any one of preceding statements comprising in helical domain 1 one or more mutation of an amino acid corresponding to the following amino acids in helical domain 1 of PbCas13b: H567, H500, K871, K857, K870, W842, E873, R877, K846, R874, R762, R791, G566, S757, or N756.
46. The engineered CRISPR-Cas protein of any one of preceding statements comprising one or more mutation of an amino acid corresponding to the following amino acids of PbCas13b: H567, H500, R762, R791, G566, S757, or N756.
47. The engineered CRISPR-Cas protein of any one of preceding statements comprising in helical domain 1 one or more mutation of an amino acid corresponding to the following amino acids in helical domain 1 of PbCas13b: H567, H500, R762, R791, G566, S757, or N756.
48. The engineered CRISPR-Cas protein of any one of preceding statements comprising one or more mutation of an amino acid corresponding to the following amino acids of PbCas13b: K871, K857, K870, W842, E873, R877, K846, R874, R762, R791, S757, or N756.
49. The engineered CRISPR-Cas protein of any one of preceding statements comprising in helical domain 1-3 one or more mutation of an amino acid corresponding to the following amino acids in helical domain 1-3 of PbCas13b: K871, K857, K870, W842, E873, R877, K846, R874, R762, R791, S757, or N756.
50. The engineered CRISPR-Cas protein of any one of preceding statements comprising one or more mutation of an amino acid corresponding to the following amino acids of PbCas13b: R762, R791, S757, or N756.
51. The engineered CRISPR-Cas protein of any one of preceding statements comprising in helical domain 1-3 one or more mutation of an amino acid corresponding to the following amino acids in helical domain 1-3 of PbCas13b: R762, R791, S757, or N756.
52. The engineered CRISPR-Cas protein of any one of preceding statements comprising one or more mutation of an amino acid corresponding to the following amino acids of PbCas13b: S658, N653, K655, N652, K590, R638, or K741.
53. The engineered CRISPR-Cas protein of any one of preceding statements comprising in helical domain 2 one or more mutation of an amino acid corresponding to the following amino acids in helical domain 2 of PbCas13b: S658, N653, K655, N652, K590, R638, or K741.
54. The engineered CRISPR-Cas protein of any one of preceding statements comprising one or more mutation of an amino acid corresponding to the following amino acids of PbCas13b: H407, N486, K484, N480, H452, N455, or K457.
55. The engineered CRISPR-Cas protein of any one of preceding statements comprising in the LID domain one or more mutation of an amino acid corresponding to the following amino acids in the LID domain of PbCas13b: H407, N486, K484, N480, H452, N455, or K457.
56. The engineered CRISPR-Cas protein of any one of preceding statements comprising one or more mutation of an amino acid corresponding to the following amino acids of PbCas13b: R56, N157, H161, R1068, N1069, or H1073.

57. The engineered CRISPR-Cas protein of any one of preceding statements comprising in a HEPN domain one or more mutation of an amino acid corresponding to the following amino acids in a HEPN domain of PbCas13b: R56, N157, H161, R1068, N1069, or H1073.

58. The engineered CRISPR-Cas protein of any one of preceding statements comprising one or more mutation of an amino acid corresponding to the following amino acids of PbCas13b: R56, N157, or H161.

59. The engineered CRISPR-Cas protein of any one of preceding statements comprising in HEPN domain 1 one or more mutation of an amino acid corresponding to the following amino acids in HEPN domain 1 of PbCas13b: R56, N157, or H161.

60. The engineered CRISPR-Cas protein of any one of preceding statements comprising one or more mutation of an amino acid corresponding to the following amino acids of PbCas13b: R1068, N1069, or H1073.

61. The engineered CRISPR-Cas protein of any one of preceding statements comprising in HEPN domain 2 one or more mutation of an amino acid corresponding to the following amino acids in HEPN domain 2 of PbCas13b: R1068, N1069, or H1073.

62. The engineered CRISPR-Cas protein of any one of preceding statements comprising one or more mutation of an amino acid corresponding to the following amino acids of PbCas13b: K393, R402, N482, T405, H407, N486, K484, N480, H452, N455, or K457.

63. The engineered CRISPR-Cas protein of any one of preceding statements comprising in the LID domain one or more mutation of an amino acid corresponding to the following amino acids in the LID domain of PbCas13b: K393, R402, N482, T405, H407, N486, K484, N480, H452, N455, or K457.

64. The engineered CRISPR-Cas protein of any one of preceding statements comprising one or more mutation of an amino acid corresponding to the following amino acids of PbCas13b: K393, R402, N482, H407, N486, K484, N480, H452, N455, or K457.

65. The engineered CRISPR-Cas protein of any one of preceding statements comprising in the LID domain one or more mutation of an amino acid corresponding to the following amino acids in the LID domain of PbCas13b: K393, R402, N482, H407, N486, K484, N480, H452, N455, or K457.

66. The engineered CRISPR-Cas protein of any one of preceding statements comprising one or more mutation of an amino acid corresponding to the following amino acids of PbCas13b: T405, H407, S658, N653, A656, K655, N652, H567, N455, H500, K871, K857, K870, W842, E873, R877, K846, R874, R762, V795, A796, R791, G566, K590, R638, H452, S757, N756, N486, K484, N480, K457, K741, K393, R402, or N482.

67. The engineered CRISPR-Cas protein of any one of preceding statements comprising one or more mutation of an amino acid corresponding to the following amino acids of PbCas13b: H407, S658, N653, K655, N652, H567, N455, H500, K871, K857, K870, W842, E873, R877, K846, R874, R762, R791, G566, K590, R638, H452, S757, N756, N486, K484, N480, K457, K741, K393, R402, or N482.

68. The engineered CRISPR-Cas protein of any one of preceding statements comprising one or more mutation of an amino acid corresponding to the following amino acids of PbCas13b: S658, N653, A656, K655, N652, H567, N455, H500, K871, K857, K870, W842, E873, R877, K846, R874, R762, V795, A796, R791, G566, K590, R638, H452, S757, N756, N486, K484, N480, K457, or K741.

69. The engineered CRISPR-Cas protein of any one of preceding statements comprising one or more mutation of an amino acid corresponding to the following amino acids of PbCas13b: S658, N653, K655, N652, H567, N455, H500, K871, K857, K870, W842, E873, R877, K846, R874, R762, R791, G566, K590, R638, H452, S757, N756, N486, K484, N480, K457, or K741.

70. The engineered CRISPR-Cas protein of any one of preceding statements comprising one or more mutation of an amino acid corresponding to the following amino acids of PbCas13b: N486, K484, N480, H452, N455, or K457.

71. The engineered CRISPR-Cas protein of any one of preceding statements comprising in the LID domain one or more mutation of an amino acid corresponding to the following amino acids in the LID domain of PbCas13b: N486, K484, N480, H452, N455, or K457.

72. The engineered CRISPR-Cas protein of any one of preceding statements comprising one or more mutation of an amino acid corresponding to the following amino acids of PbCas13b: K393, R402, N482, N486, K484, N480, H452, N455, or K457.

73. The engineered CRISPR-Cas protein of any one of preceding statements comprising in the LID domain one or more mutation of an amino acid corresponding to the following amino acids in the LID domain of PbCas13b: K393, R402, N482, N486, K484, N480, H452, N455, or K457.

74. The engineered CRISPR-Cas protein of any one of preceding statements comprising one or more mutation of an amino acid corresponding to the following amino acids of PbCas13b: S658, N653, A656, K655, N652, H567, N455, H500, K871, K857, K870, W842, E873, R877, K846, R874, R762, V795, A796, R791, G566, K590, R638, H452, S757, N756, N486, K484, N480, K457, K741, K393, R402, or N482.

75. The engineered CRISPR-Cas protein of any one of preceding statements comprising one or more mutation of an amino acid corresponding to the following amino acids of PbCas13b: S658, N653, K655, N652, H567, N455, H500, K871, K857, K870, W842, E873, R877, K846, R874, R762, R791, G566, K590, R638, H452, S757, N756, N486, K484, N480, K457, K741, K393, R402, or N482.

76. The engineered CRISPR-Cas protein of any one of preceding statements comprising one or more mutation of an amino acid corresponding to the following amino acids of *Prevotella buccae* Cas13b (PbCas13b): R53, Y164, K943, or R1041.

77. The engineered CRISPR-Cas protein of any one of preceding statements comprising one or more mutation of an amino acid corresponding to the following amino acids of *Prevotella buccae* Cas13b (PbCas13b): R53 or Y164.

78. The engineered CRISPR-Cas protein of any one of preceding statements comprising one or more mutation of an amino acid corresponding to the following amino acids of *Prevotella buccae* Cas13b (PbCas13b): K943 or R1041.

79. The engineered CRISPR-Cas protein of any one of preceding statements comprising in a HEPN domain one or more mutation of an amino acid corresponding to the following amino acids in a HEPN domain of *Prevotella buccae* Cas13b (PbCas13b): R53, Y164, K943, or R1041.

80. The engineered CRISPR-Cas protein of any one of preceding statements comprising in HEPN domain 1 one or more mutation of an amino acid corresponding to the following amino acids in HEPN domain 1 of *Prevotella buccae* Cas13b (PbCas13b): R53 or Y164.

81. The engineered CRISPR-Cas protein of any one of preceding statements comprising in HEPN domain 2 one or more mutation of an amino acid corresponding to the following amino acids in HEPN domain 2 of *Prevotella buccae* Cas13b (PbCas13b): K943 or R1041.

82. The engineered CRISPR-Cas protein of any one of preceding statements comprising one or more mutation of an amino acid corresponding to the following amino acids of *Prevotella buccae* Cas13b (PbCas13b): R53, Y164, K943, R1041, R56, N157, H161, R1068, N1069, or H1073.

83. The engineered CRISPR-Cas protein of any one of preceding statements comprising one or more mutation of an amino acid corresponding to the following amino acids of *Prevotella buccae* Cas13b (PbCas13b): R53, Y164, R56, N157, or H161.

84. The engineered CRISPR-Cas protein of any one of preceding statements comprising one or more mutation of an amino acid corresponding to the following amino acids of *Prevotella buccae* Cas13b (PbCas13b): K943, R1041, R1068, N1069, or H1073.

85. The engineered CRISPR-Cas protein of any one of preceding statements comprising in a HEPN domain one or more mutation of an amino acid corresponding to the following amino acids in a HEPN domain of *Prevotella buccae* Cas13b (PbCas13b): R53, Y164, K943, R1041, R56, N157, H161, R1068, N1069, or H1073.

86. The engineered CRISPR-Cas protein of any one of preceding statements comprising in HEPN domain 1 one or more mutation of an amino acid corresponding to the following amino acids in HEPN domain 1 of *Prevotella buccae* Cas13b (PbCas13b): R53, Y164, R56, N157, or H161.

87. The engineered CRISPR-Cas protein of any one of preceding statements comprising in HEPN domain 2 one or more mutation of an amino acid corresponding to the following amino acids in HEPN domain 2 of *Prevotella buccae* Cas13b (PbCas13b): K943, R1041, R1068, N1069, or H1073.

88. The engineered CRISPR-Cas protein of any one of preceding statements comprising one or more mutation of an amino acid corresponding to the following amino acids of *Prevotella buccae* Cas13b (PbCas13b): R53, Y164, K183, K193, K943, or R1041.

89. The engineered CRISPR-Cas protein of any one of preceding statements comprising one or more mutation of an amino acid corresponding to the following amino acids of *Prevotella buccae* Cas13b (PbCas13b): R53, Y164, K183, or K193.

90. The engineered CRISPR-Cas protein of any one of preceding statements comprising one or more mutation of an amino acid corresponding to the following amino acids of *Prevotella buccae* Cas13b (PbCas13b): K943 or R1041.

91. The engineered CRISPR-Cas protein of any one of preceding statements comprising in a HEPN domain one or more mutation of an amino acid corresponding to the following amino acids in a HEPN domain of *Prevotella buccae* Cas13b (PbCas13b): R53, Y164, K183, K193, K943, or R1041.

92. The engineered CRISPR-Cas protein of any one of preceding statements comprising in HEPN domain 1 one or more mutation of an amino acid corresponding to the following amino acids in HEPN domain 1 of *Prevotella buccae* Cas13b (PbCas13b): R53, Y164, K183, or K193.

93. The engineered CRISPR-Cas protein of any one of preceding statements comprising in HEPN domain 2 one or more mutation of an amino acid corresponding to the following amino acids in HEPN domain 2 of *Prevotella buccae* Cas13b (PbCas13b): K943 or R1041.

94. The engineered CRISPR-Cas protein of any one of preceding statements comprising one or more mutation of an amino acid corresponding to the following amino acids of *Prevotella buccae* Cas13b (PbCas13b): R53, Y164, K183, K193, K943, R1041, R56, N157, H161, R1068, N1069, or H1073.

95. The engineered CRISPR-Cas protein of any one of preceding statements comprising one or more mutation of an amino acid corresponding to the following amino acids of *Prevotella buccae* Cas13b (PbCas13b): R53, Y164, K183, K193, R56, N157, or H161.

96. The engineered CRISPR-Cas protein of any one of preceding statements comprising one or more mutation of an amino acid corresponding to the following amino acids of *Prevotella buccae* Cas13b (PbCas13b): K943, R1041, R1068, N1069, or H1073.

97. The engineered CRISPR-Cas protein of any one of preceding statements comprising in a HEPN domain one or more mutation of an amino acid corresponding to the following amino acids in a HEPN domain of *Prevotella buccae* Cas13b (PbCas13b): R53, Y164, K183, K193, K943, R1041, R56, N157, H161, R1068, N1069, or H1073.

98. The engineered CRISPR-Cas protein of any one of preceding statements comprising in HEPN domain 1 one or more mutation of an amino acid corresponding to the following amino acids in HEPN domain 1 of *Prevotella buccae* Cas13b (PbCas13b): R53, Y164, K183, K193, R56, N157, or H161.

99. The engineered CRISPR-Cas protein of any one of preceding statements comprising in HEPN domain 2 one or more mutation of an amino acid corresponding to the following amino acids in HEPN domain 2 of *Prevotella buccae* Cas13b (PbCas13b): K943, R1041, R1068, N1069, or H1073.

100. The engineered CRISPR-Cas protein of any one of preceding statements comprising one or more mutation of an amino acid corresponding to the following amino acids of *Prevotella buccae* Cas13b (PbCas13b): K183 or K193.

101. The engineered CRISPR-Cas protein of any one of preceding statements comprising in HEPN domain 1 one or more mutation of an amino acid corresponding to the following amino acids in HEPN domain 1 of *Prevotella buccae* Cas13b (PbCas13b): K183 or K193.

102. The engineered CRISPR-Cas protein of any one of preceding statements comprising one or more mutation of an amino acid corresponding to the following amino acids of *Prevotella buccae* Cas13b (PbCas13b): R53, Y164, K943, or R1041.

103. The engineered CRISPR-Cas protein of any one of preceding statements comprising in a HEPN domain one or more mutation of an amino acid corresponding to the following amino acids in a HEPN domain of *Prevotella buccae* Cas13b (PbCas13b): R53, Y164, K943, or R1041.

104. The engineered CRISPR-Cas protein of any one of preceding statements comprising one or more mutation of an amino acid corresponding to the following amino acids of *Prevotella buccae* Cas13b (PbCas13b): R53, K943, or R1041; preferably R53A, R53K, R53D, or R53E; K943A, K943R, K943D, or K943E; or R1041A, R1041K, R1041D, or R1041E.

105. The engineered CRISPR-Cas protein of any one of preceding statements comprising in a HEPN domain one or more mutation of an amino acid corresponding to the following amino acids in a HEPN domain of *Prevotella buccae* Cas13b (PbCas13b): R53, K943, or R1041; preferably R53A, R53K, R53D, or R53E; K943A, K943R, K943D, or K943E; or R1041A, R1041K, R1041D, or R1041E.

106. The engineered CRISPR-Cas protein of any one of preceding statements comprising a mutation of an amino acid corresponding to amino acid Y164 of *Prevotella buccae* Cas13b (PbCas13b), preferably Y164A, Y164F, or Y164W.

107. The engineered CRISPR-Cas protein of any one of preceding statements comprising HEPN domain 1 a mutation of an amino acid corresponding to amino acid Y164 HEPN domain 1 of *Prevotella buccae* Cas13b (PbCas13b), preferably Y164A, Y164F, or Y164W.

108. The engineered CRISPR-Cas protein of any one of preceding statements comprising one or more mutation of an amino acid corresponding to the following amino acids of *Prevotella buccae* Cas13b (PbCas13b): T405, H407, K457, D434, K431, R402, K393, R482, N480, D396, E397, D398, or E399.

109. The engineered CRISPR-Cas protein of any one of preceding statements comprising in the LID domain one or more mutation of an amino acid corresponding to the following amino acids in the LID domain of *Prevotella buccae* Cas13b (PbCas13b): T405, H407, K457, D434, K431, R402, K393, R482, N480, D396, E397, D398, or E399.

110. The engineered CRISPR-Cas protein of any one of preceding statements comprising a mutation of an amino acid corresponding to amino acid H407 of *Prevotella buccae* Cas13b (PbCas13b), preferably H407Y, H407W, or H407F.

111. The engineered CRISPR-Cas protein of any one of preceding statements comprising one or more mutation of an amino acid corresponding to the following amino acids of *Prevotella buccae* Cas13b (PbCas13b): R402, K393, R482, N480, D396, E397, D398, or E399.

112. The engineered CRISPR-Cas protein of any one of preceding statements comprising in the LID domain one or more mutation of an amino acid corresponding to the following amino acids in the LID domain of *Prevotella buccae* Cas13b (PbCas13b): R402, K393, R482, N480, D396, E397, D398, or E399.

113. The engineered CRISPR-Cas protein of any one of preceding statements comprising one or more mutation of an amino acid corresponding to the following amino acids of *Prevotella buccae* Cas13b (PbCas13b): K457, D434, or K431.

114. The engineered CRISPR-Cas protein of any one of preceding statements comprising in the LID domain one or more mutation of an amino acid corresponding to the following amino acids in the LID domain of *Prevotella buccae* Cas13b (PbCas13b): K457, D434, or K431.

115. The engineered CRISPR-Cas protein of any one of preceding statements comprising one or more mutation of an amino acid corresponding to the following amino acids of *Prevotella buccae* Cas13b (PbCas13b): H500, K570, K590, N634, R638, N652, N653, K655, S658, K741, K744, N756, S757, R762, R791, K846, K857, K870, R877, R600, K607, K612, R614, K617, K826, K828, K829, R824, R830, Q831, K835, K836, R838, R618, Q646, N647, N653, or N652.

116. The engineered CRISPR-Cas protein of any one of preceding statements comprising in a helical domain one or more mutation of an amino acid corresponding to the following amino acids in a helical domain of *Prevotella buccae* Cas13b (PbCas13b): H500, K570, K590, N634, R638, N652, N653, K655, S658, K741, K744, N756, S757, R762, R791, K846, K857, K870, R877, R600, K607, K612, R614, K617, K826, K828, K829, R824, R830, Q831, K835, K836, R838, R618, Q646, N647, N653, or N652.

117. The engineered CRISPR-Cas protein of any one of preceding statements comprising one or more mutation of an amino acid corresponding to the following amino acids of *Prevotella buccae* Cas13b (PbCas13b): H500, K570, N756, S757, R762, R791, K846, K857, K870, R877, K826, K828, K829, R824, R830, Q831, K835, K836, or R838.

118. The engineered CRISPR-Cas protein of any one of preceding statements comprising in helical domain 1 one or more mutation of an amino acid corresponding to the following amino acids in helical domain 1 of *Prevotella buccae* Cas13b (PbCas13b): H500, K570, N756, S757, R762, R791, K846, K857, K870, R877, K826, K828, K829, R824, R830, Q831, K835, K836, or R838.

119. The engineered CRISPR-Cas protein of any one of preceding statements comprising one or more mutation of an amino acid corresponding to the following amino acids of *Prevotella buccae* Cas13b (PbCas13b): H500, K570, N756, S757, R762, or R791.

120. The engineered CRISPR-Cas protein of any one of preceding statements comprising in helical domain 1 one or more mutation of an amino acid corresponding to the following amino acids in helical domain 1 of *Prevotella buccae* Cas13b (PbCas13b): H500, K570, N756, S757, R762, or R791.

121. The engineered CRISPR-Cas protein of any one of preceding statements comprising one or more mutation of an amino acid corresponding to the following amino acids of *Prevotella buccae* Cas13b (PbCas13b): K846, K857, K870, R877, K826, K828, K829, R824, R830, Q831, K835, K836, or R838.

122. The engineered CRISPR-Cas protein of any one of preceding statements comprising in the bridge helix domain one or more mutation of an amino acid corresponding to the following amino acids in the bridge helix domain of *Prevotella buccae* Cas13b (PbCas13b): K846, K857, K870, R877, K826, K828, K829, R824, R830, Q831, K835, K836, or R838.

123. The engineered CRISPR-Cas protein of any one of preceding statements comprising one or more mutation of an amino acid corresponding to the following amino acids of *Prevotella buccae* Cas13b (PbCas13b): H500 or K570.

124. The engineered CRISPR-Cas protein of any one of preceding statements comprising in helical domain 1-2 one or more mutation of an amino acid corresponding to the following amino acids in helical domain 1-2 of *Prevotella buccae* Cas13b (PbCas13b): H500 or K570.

125. The engineered CRISPR-Cas protein of any one of preceding statements comprising one or more mutation of an amino acid corresponding to the following amino acids of *Prevotella buccae* Cas13b (PbCas13b): N756, S757, R762, R791, K846, K857, K870, R877, K826, K828, K829, R824, R830, Q831, K835, K836, or R838.

126. The engineered CRISPR-Cas protein of any one of preceding statements comprising in helical domain 1-3 one or more mutation of an amino acid corresponding to the following amino acids in helical domain 1-3 of *Prevotella buccae* Cas13b (PbCas13b): N756, S757, R762, R791, K846, K857, K870, R877, K826, K828, K829, R824, R830, Q831, K835, K836, or R838.

127. The engineered CRISPR-Cas protein of any one of preceding statements comprising one or more mutation of an amino acid corresponding to the following amino acids of *Prevotella buccae* Cas13b (PbCas13b): N756, S757, R762, or R791.

128. The engineered CRISPR-Cas protein of any one of preceding statements comprising in helical domain 1-3 one or more mutation of an amino acid corresponding to the following amino acids in helical domain 1-3 of *Prevotella buccae* Cas13b (PbCas13b): N756, S757, R762, or R791.

129. The engineered CRISPR-Cas protein of any one of preceding statements comprising one or more mutation of an amino acid corresponding to the following amino acids of *Prevotella buccae* Cas13b (PbCas13b): N756, S757, R762, R791, K846, K857, K870, or R877.

130. The engineered CRISPR-Cas protein of any one of preceding statements comprising in helical domain 1-3 one or more mutation of an amino acid corresponding to the following amino acids in helical domain 1-3 of *Prevotella buccae* Cas13b (PbCas13b): N756, S757, R762, R791, K846, K857, K870, or R877.

131. The engineered CRISPR-Cas protein of any one of preceding statements comprising one or more mutation of an amino acid corresponding to the following amino acids of *Prevotella buccae* Cas13b (PbCas13b): K826, K828, K829, R824, R830, Q831, K835, K836, or R838.

132. The engineered CRISPR-Cas protein of any one of preceding statements comprising in helical domain 1-3 one or more mutation of an amino acid corresponding to the following amino acids in helical domain 1-3 of *Prevotella buccae* Cas13b (PbCas13b): K826, K828, K829, R824, R830, Q831, K835, K836, or R838.

133. The engineered CRISPR-Cas protein of any one of preceding statements comprising one or more mutation of an amino acid corresponding to the following amino acids of *Prevotella buccae* Cas13b (PbCas13b): K590, N634, R638, N652, N653, K655, S658, K741, K744, R600, K607, K612, R614, K617, R618, Q646, N647, N653, or N652.

134. The engineered CRISPR-Cas protein of any one of preceding statements comprising in helical domain 2 one or more mutation of an amino acid corresponding to the following amino acids in helical domain 2 of *Prevotella buccae* Cas13b (PbCas13b): K590, N634, R638, N652, N653, K655, S658, K741, K744, R600, K607, K612, R614, K617, R618, Q646, N647, N653, or N652.

135. The engineered CRISPR-Cas protein of any one of preceding statements comprising one or more mutation of an amino acid corresponding to the following amino acids of *Prevotella buccae* Cas13b (PbCas13b): Q646 or N647.

136. The engineered CRISPR-Cas protein of any one of preceding statements comprising in helical domain 2 one or more mutation of an amino acid corresponding to the following amino acids in helical domain 2 of *Prevotella buccae* Cas13b (PbCas13b): Q646 or N647.

137. The engineered CRISPR-Cas protein of any one of preceding statements comprising one or more mutation of an amino acid corresponding to the following amino acids of *Prevotella buccae* Cas13b (PbCas13b): N653 or N652.

138. The engineered CRISPR-Cas protein of any one of preceding statements comprising in helical domain 2 one or more mutation of an amino acid corresponding to the following amino acids in helical domain 2 of *Prevotella buccae* Cas13b (PbCas13b): N653 or N652.

139. The engineered CRISPR-Cas protein of any one of preceding statements comprising one or more mutation of an amino acid corresponding to the following amino acids of *Prevotella buccae* Cas13b (PbCas13b): K590, N634, R638, N652, N653, K655, S658, K741, or K744.

140. The engineered CRISPR-Cas protein of any one of preceding statements comprising in helical domain 2 one or more mutation of an amino acid corresponding to the following amino acids in helical domain 2 of *Prevotella buccae* Cas13b (PbCas13b): K590, N634, R638, N652, N653, K655, S658, K741, or K744.

141. The engineered CRISPR-Cas protein of any one of preceding statements comprising one or more mutation of an amino acid corresponding to the following amino acids of *Prevotella buccae* Cas13b (PbCas13b): R600, K607, K612, R614, K617, or R618.

142. The engineered CRISPR-Cas protein of any one of preceding statements comprising in helical domain 2 one or more mutation of an amino acid corresponding to the following amino acids in helical domain 2 of *Prevotella buccae* Cas13b (PbCas13b): R600, K607, K612, R614, K617, or R618.

143. The engineered CRISPR-Cas protein of any one of preceding statements comprising one or more mutation of an amino acid corresponding to the following amino acids of *Prevotella buccae* Cas13b (PbCas13b): R285, R287, K292, E296, N297, or K294.

144. The engineered CRISPR-Cas protein of any one of preceding statements comprising in the IDL domain one or more mutation of an amino acid corresponding to the following amino acids in the IDL domain of *Prevotella buccae* Cas13b (PbCas13b): R285, R287, K292, E296, N297, or K294.

145. The engineered CRISPR-Cas protein of any one of preceding statements comprising one or more mutation of an amino acid corresponding to the following amino acids of *Prevotella buccae* Cas13b (PbCas13b): R285, K292, E296, or N297.

146. The engineered CRISPR-Cas protein of any one of preceding statements comprising in the IDL domain one or more mutation of an amino acid corresponding to the following amino acids in the IDL domain of *Prevotella buccae* Cas13b (PbCas13b): R285, K292, E296, or N297.

147. The engineered CRISPR-Cas protein of any one of preceding statements comprising one or more mutation of an amino acid corresponding to the following amino acids of *Prevotella buccae* Cas13b (PbCas13b): T405, H500, K570, K590, N634, R638, N652, N653, K655, S658, K741, K744, N756, S757, R762, R791, K846, K857, K870, R877, K183, K193, R600, K607, K612, R614, K617, K826, K828, K829, R824, R830, Q831, K835, K836, R838, R618, D434, K431, R285, R287, K292, E296, N297, Q646, N647, or K294.

148. The engineered CRISPR-Cas protein of any one of preceding statements comprising one or more mutation of an amino acid corresponding to the following amino acids of *Prevotella buccae* Cas13b (PbCas13b): R402, K393, N653, N652, R482, N480, D396, E397, D398, or E399.

149. The engineered CRISPR-Cas protein of any one of preceding statements comprising one or more mutation of an amino acid corresponding to the following amino acids of *Prevotella buccae* Cas13b (PbCas13b): R53, K655, R762, or R1041; preferably R53A or R53D; K655A; R762A; or R1041E or R1041D.

150. The engineered CRISPR-Cas protein of any one of preceding statements comprising one or more mutation of an amino acid corresponding to the following amino acids of *Prevotella buccae* Cas13b (PbCas13b): N297, E296, K292, or R285; preferably N297A, E296A, K292A, or R285A.

151. The engineered CRISPR-Cas protein of any one of preceding statements comprising in (the central channel of) the IDL domain one or more mutation of an amino acid corresponding to the following amino acids in (the central channel of) the IDL domain of *Prevotella buccae* Cas13b (PbCas13b): N297, E296, K292, or R285; preferably N297A, E296A, K292A, or R285A.

152. The engineered CRISPR-Cas protein of any one of preceding statements comprising one or more mutation of an amino acid corresponding to the following amino acids of *Prevotella buccae* Cas13b (PbCas13b): Q831, K836, R838, N652, N653, R830, K655 or R762; preferably Q831A, K836A, R838A, N652A, N653A, R830A, K655A, or R762A.

153. The engineered CRISPR-Cas protein of any one of preceding statements comprising one or more mutation of an amino acid corresponding to the following amino acids of *Prevotella buccae* Cas13b (PbCas13b): N652, N653, R830, K655 or R762; preferably N652A, N653A, R830A, K655A, or R762A.

154. The engineered CRISPR-Cas protein of any one of preceding statements comprising one or more mutation of an amino acid corresponding to the following amino acids of *Prevotella buccae* Cas13b (PbCas13b): K655 or R762; preferably K655A or R762A.

155. The engineered CRISPR-Cas protein of any one of preceding statements comprising in a helical domain one or more mutation of an amino acid corresponding to the following amino acids in a helical domain of *Prevotella buccae* Cas13b (PbCas13b): Q831, K836, R838, N652, N653, R830, K655 or R762; preferably Q831A, K836A, R838A, N652A, N653A, R830A, K655A, or R762A.

156. The engineered CRISPR-Cas protein of any one of preceding statements comprising a helical domain one or more mutation of an amino acid corresponding to the following amino acids a helical domain of *Prevotella buccae* Cas13b (PbCas13b): N652, N653, R830, K655 or R762; preferably N652A, N653A, R830A, K655A, or R762A.

157. The engineered CRISPR-Cas protein of any one of preceding statements comprising in helical domain 2 one or more mutation of an amino acid corresponding to the following amino acids in helical domain 2 of *Prevotella buccae* Cas13b (PbCas13b): K655 or R762; preferably K655A or R762A.

158. The engineered CRISPR-Cas protein of any one of preceding statements comprising one or more mutation of an amino acid corresponding to the following amino acids of *Prevotella buccae* Cas13b (PbCas13b): R614, K607, K193, K183 or R600; preferably R614A, K607A, K193A, K183A or R600A.

159. The engineered CRISPR-Cas protein of any one of preceding statements comprising in the trans-subunit loop of helical domain 2 one or more mutation of an amino acid corresponding to the following amino acids in the trans-subunit loop of helical domain 2 of *Prevotella buccae* Cas13b (PbCas13b): Q646 or N647; preferably Q646A or N647A.

160. The engineered CRISPR-Cas protein of any one of preceding statements comprising one or more mutation of an amino acid corresponding to the following amino acids of *Prevotella buccae* Cas13b (PbCas13b): R53 or R1041; preferably R53A or R53D, or R1041E or R1041D.

161. The engineered CRISPR-Cas protein of any one of preceding statements comprising in a HEPN domain one or more mutation of an amino acid corresponding to the following amino acids in a HEPN domain of *Prevotella buccae* Cas13b (PbCas13b): R53 or R1041; preferably R53A or R53D, or R1041E or R1041D.

162. The engineered CRISPR-Cas protein of any one of preceding statements comprising one or more mutation of an amino acid corresponding to the following amino acids of *Prevotella buccae* Cas13b (PbCas13b): K457, D397, E398, D399, E400, T405, H407 or D434; preferably D397A, E398A, D399A, E400A, T405A, H407A, H407W, H407Y, H407F or D434A.

163. The engineered CRISPR-Cas protein of any one of preceding statements comprising in the LID domain one or more mutation of an amino acid corresponding to the following amino acids in the LID domain of *Prevotella buccae* Cas13b (PbCas13b): K457, D397, E398, D399, E400, T405, H407 or D434; preferably D397A, E398A, D399A, E400A, T405A, H407A, H407W, H407Y, H407F or D434A.

164. The engineered CRISPR-Cas protein of any one of preceding statements, wherein the amino acids correspond to the following amino acids of *Prevotella buccae* Cas13b (PbCas13b): amino acids 46-57, 73-79, 152-164, 1036-1046, and 1064-1074.

165. The engineered CRISPR-Cas protein of any one of preceding statements, comprising one or more mutation of an amino acid corresponding to the following amino acids of *Prevotella buccae* Cas13b (PbCas13b): R156, N157, H161, R1068, N1069, and H1073.

166. The engineered CRISPR-Cas protein of any one of preceding statements, comprising one or more mutation of an amino acid corresponding to the following amino acids of *Prevotella buccae* Cas13b (PbCas13b): R285, R287, K292, K294, E296, and N297.

167. The engineered CRISPR-Cas protein of any one of preceding statements, comprising one or more mutation of an amino acid corresponding to the following amino acids of *Prevotella buccae* Cas13b (PbCas13b): K826, K828, K829, R824, R830, Q831, K835, K836, and R838.

168. The engineered CRISPR-Cas protein of any one of preceding statements, comprising one or more mutation of an amino acid corresponding to the following amino acids of *Prevotella buccae* Cas13b (PbCas13b): T405, H407, K457, H500, K570, K590, N634, R638, N652, N653, K655, S658, K741, K744, N756, S757, R762, R791, K846, K857, K870, and R877.

169. The engineered CRISPR-Cas protein of any one of preceding statements comprising a mutation of an amino acid corresponding to amino acid T405 of *Prevotella buccae* Cas13b (PbCas13b).

170. The engineered CRISPR-Cas protein of any one of preceding statements comprising a mutation of an amino acid corresponding to amino acid H407 of *Prevotella buccae* Cas13b (PbCas13b).

171. The engineered CRISPR-Cas protein of any one of preceding statements comprising a mutation of an amino acid corresponding to amino acid K457 of *Prevotella buccae* Cas13b (PbCas13b).

172. The engineered CRISPR-Cas protein of any one of preceding statements comprising a mutation of an amino acid corresponding to amino acid H500 of *Prevotella buccae* Cas13b (PbCas13b).

173. The engineered CRISPR-Cas protein of any one of preceding statements comprising a mutation of an amino acid corresponding to amino acid K570 of *Prevotella buccae* Cas13b (PbCas13b).

174. The engineered CRISPR-Cas protein of any one of preceding statements comprising a mutation of an amino acid corresponding to amino acid K590 of *Prevotella buccae* Cas13b (PbCas13b).

175. The engineered CRISPR-Cas protein of any one of preceding statements comprising a mutation of an amino acid corresponding to amino acid N634 of *Prevotella buccae* Cas13b (PbCas13b).

176. The engineered CRISPR-Cas protein of any one of preceding statements comprising a mutation of an amino acid corresponding to amino acid R638 of *Prevotella buccae* Cas13b (PbCas13b).

177. The engineered CRISPR-Cas protein of any one of preceding statements comprising a mutation of an amino acid corresponding to amino acid N652 of *Prevotella buccae* Cas13b (PbCas13b).

178. The engineered CRISPR-Cas protein of any one of preceding statements comprising a mutation of an amino acid corresponding to amino acid N653 of *Prevotella buccae* Cas13b (PbCas13b).

179. The engineered CRISPR-Cas protein of any one of preceding statements comprising a mutation of an amino acid corresponding to amino acid K655 of *Prevotella buccae* Cas13b (PbCas13b).

180. The engineered CRISPR-Cas protein of any one of preceding statements comprising a mutation of an amino acid corresponding to amino acid S658 of *Prevotella buccae* Cas13b (PbCas13b).

181. The engineered CRISPR-Cas protein of any one of preceding statements comprising a mutation of an amino acid corresponding to amino acid K741 of *Prevotella buccae* Cas13b (PbCas13b).

182. The engineered CRISPR-Cas protein of any one of preceding statements comprising a mutation of an amino acid corresponding to amino acid K744 of *Prevotella buccae* Cas13b (PbCas13b).

183. The engineered CRISPR-Cas protein of any one of preceding statements comprising a mutation of an amino acid corresponding to amino acid N756 of *Prevotella buccae* Cas13b (PbCas13b).

184. The engineered CRISPR-Cas protein of any one of preceding statements comprising a mutation of an amino acid corresponding to amino acid S757 of *Prevotella buccae* Cas13b (PbCas13b).

185. The engineered CRISPR-Cas protein of any one of preceding statements comprising a mutation of an amino acid corresponding to amino acid R762 of *Prevotella buccae* Cas13b (PbCas13b).

186. The engineered CRISPR-Cas protein of any one of preceding statements comprising a mutation of an amino acid corresponding to amino acid R791 of *Prevotella buccae* Cas13b (PbCas13b).

187. The engineered CRISPR-Cas protein of any one of preceding statements comprising a mutation of an amino acid corresponding to amino acid K846 of *Prevotella buccae* Cas13b (PbCas13b).

188. The engineered CRISPR-Cas protein of any one of preceding statements comprising a mutation of an amino acid corresponding to amino acid K857 of *Prevotella buccae* Cas13b (PbCas13b).

189. The engineered CRISPR-Cas protein of any one of preceding statements comprising a mutation of an amino acid corresponding to amino acid K870 of *Prevotella buccae* Cas13b (PbCas13b).

190. The engineered CRISPR-Cas protein of any one of preceding statements comprising a mutation of an amino acid corresponding to amino acid R877 of *Prevotella buccae* Cas13b (PbCas13b).

191. The engineered CRISPR-Cas protein of any one of preceding statements comprising a mutation of an amino acid corresponding to amino acid K183 of *Prevotella buccae* Cas13b (PbCas13b).

192. The engineered CRISPR-Cas protein of any one of preceding statements comprising a mutation of an amino acid corresponding to amino acid K193 of *Prevotella buccae* Cas13b (PbCas13b).

193. The engineered CRISPR-Cas protein of any one of preceding statements comprising a mutation of an amino acid corresponding to amino acid R600 of *Prevotella buccae* Cas13b (PbCas13b).

194. The engineered CRISPR-Cas protein of any one of preceding statements comprising a mutation of an amino acid corresponding to amino acid K607 of *Prevotella buccae* Cas13b (PbCas13b).

195. The engineered CRISPR-Cas protein of any one of preceding statements comprising a mutation of an amino acid corresponding to amino acid K612 of *Prevotella buccae* Cas13b (PbCas13b).

196. The engineered CRISPR-Cas protein of any one of preceding statements comprising a mutation of an amino acid corresponding to amino acid R614 of *Prevotella buccae* Cas13b (PbCas13b).

197. The engineered CRISPR-Cas protein of any one of preceding statements comprising a mutation of an amino acid corresponding to amino acid K617 of *Prevotella buccae* Cas13b (PbCas13b).

198. The engineered CRISPR-Cas protein of any one of preceding statements comprising a mutation of an amino acid corresponding to amino acid K826 of *Prevotella buccae* Cas13b (PbCas13b).

199. The engineered CRISPR-Cas protein of any one of preceding statements comprising a mutation of an amino acid corresponding to amino acid K828 of *Prevotella buccae* Cas13b (PbCas13b).

200. The engineered CRISPR-Cas protein of any one of preceding statements comprising a mutation of an amino acid corresponding to amino acid K829 of *Prevotella buccae* Cas13b (PbCas13b).

201. The engineered CRISPR-Cas protein of any one of preceding statements comprising a mutation of an amino acid corresponding to amino acid R824 of *Prevotella buccae* Cas13b (PbCas13b).

202. The engineered CRISPR-Cas protein of any one of preceding statements comprising a mutation of an amino acid corresponding to amino acid R830 of *Prevotella buccae* Cas13b (PbCas13b).

203. The engineered CRISPR-Cas protein of any one of preceding statements comprising a mutation of an amino acid corresponding to amino acid Q831 of *Prevotella buccae* Cas13b (PbCas13b).

204. The engineered CRISPR-Cas protein of any one of preceding statements comprising a mutation of an amino acid corresponding to amino acid K835 of *Prevotella buccae* Cas13b (PbCas13b).

205. The engineered CRISPR-Cas protein of any one of preceding statements comprising a mutation of an amino acid corresponding to amino acid K836 of *Prevotella buccae* Cas13b (PbCas13b).

206. The engineered CRISPR-Cas protein of any one of preceding statements comprising a mutation of an amino acid corresponding to amino acid R838 of *Prevotella buccae* Cas13b (PbCas13b).

207. The engineered CRISPR-Cas protein of any one of preceding statements comprising a mutation of an amino acid corresponding to amino acid R618 of *Prevotella buccae* Cas13b (PbCas13b).

208. The engineered CRISPR-Cas protein of any one of preceding statements comprising a mutation of an amino acid corresponding to amino acid D434 of *Prevotella buccae* Cas13b (PbCas13b).

209. The engineered CRISPR-Cas protein of any one of preceding statements comprising a mutation of an amino acid corresponding to amino acid K431 of *Prevotella buccae* Cas13b (PbCas13b).

210. The engineered CRISPR-Cas protein of any one of preceding statements comprising a mutation of an amino acid corresponding to amino acid R53 of *Prevotella buccae* Cas13b (PbCas13b).

211. The engineered CRISPR-Cas protein of any one of preceding statements comprising a mutation of an amino acid corresponding to amino acid K943 of *Prevotella buccae* Cas13b (PbCas13b).

212. The engineered CRISPR-Cas protein of any one of preceding statements comprising a mutation of an amino acid corresponding to amino acid R1041 of *Prevotella buccae* Cas13b (PbCas13b).

213. The engineered CRISPR-Cas protein of any one of preceding statements comprising a mutation of an amino acid corresponding to amino acid Y164 of *Prevotella buccae* Cas13b (PbCas13b).

214. The engineered CRISPR-Cas protein of any one of preceding statements comprising a mutation of an amino acid corresponding to amino acid R285 of *Prevotella buccae* Cas13b (PbCas13b).

215. The engineered CRISPR-Cas protein of any one of preceding statements comprising a mutation of an amino acid corresponding to amino acid R287 of *Prevotella buccae* Cas13b (PbCas13b).

216. The engineered CRISPR-Cas protein of any one of preceding statements comprising a mutation of an amino acid corresponding to amino acid K292 of *Prevotella buccae* Cas13b (PbCas13b).

217. The engineered CRISPR-Cas protein of any one of preceding statements comprising a mutation of an amino acid corresponding to amino acid E296 of *Prevotella buccae* Cas13b (PbCas13b).

218. The engineered CRISPR-Cas protein of any one of preceding statements comprising a mutation of an amino acid corresponding to amino acid N297 of *Prevotella buccae* Cas13b (PbCas13b).

219. The engineered CRISPR-Cas protein of any one of preceding statements comprising a mutation of an amino acid corresponding to amino acid Q646 of *Prevotella buccae* Cas13b (PbCas13b).

220. The engineered CRISPR-Cas protein of any one of preceding statements comprising a mutation of an amino acid corresponding to amino acid N647 of *Prevotella buccae* Cas13b (PbCas13b).

221. The engineered CRISPR-Cas protein of any one of preceding statements comprising a mutation of an amino acid corresponding to amino acid R402 of *Prevotella buccae* Cas13b (PbCas13b).

222. The engineered CRISPR-Cas protein of any one of preceding statements comprising a mutation of an amino acid corresponding to amino acid K393 of *Prevotella buccae* Cas13b (PbCas13b).

223. The engineered CRISPR-Cas protein of any one of preceding statements comprising a mutation of an amino acid corresponding to amino acid N653 of *Prevotella buccae* Cas13b (PbCas13b).

224. The engineered CRISPR-Cas protein of any one of preceding statements comprising a mutation of an amino acid corresponding to amino acid N652 of *Prevotella buccae* Cas13b (PbCas13b).

225. The engineered CRISPR-Cas protein of any one of preceding statements comprising a mutation of an amino acid corresponding to amino acid R482 of *Prevotella buccae* Cas13b (PbCas13b).

226. The engineered CRISPR-Cas protein of any one of preceding statements comprising a mutation of an amino acid corresponding to amino acid N480 of *Prevotella buccae* Cas13b (PbCas13b).

227. The engineered CRISPR-Cas protein of any one of preceding statements comprising a mutation of an amino acid corresponding to amino acid D396 of *Prevotella buccae* Cas13b (PbCas13b).

228. The engineered CRISPR-Cas protein of any one of preceding statements comprising a mutation of an amino acid corresponding to amino acid E397 of *Prevotella buccae* Cas13b (PbCas13b).

229. The engineered CRISPR-Cas protein of any one of preceding statements comprising a mutation of an amino acid corresponding to amino acid D398 of *Prevotella buccae* Cas13b (PbCas13b).

230. The engineered CRISPR-Cas protein of any one of preceding statements comprising a mutation of an amino acid corresponding to amino acid E399 of *Prevotella buccae* Cas13b (PbCas13b).

231. The engineered CRISPR-Cas protein of any one of preceding statements comprising a mutation of an amino acid corresponding to amino acid K294 of *Prevotella buccae* Cas13b (PbCas13b).

232. The engineered CRISPR-Cas protein of any one of preceding statements comprising a mutation of an amino acid corresponding to amino acid E400 of *Prevotella buccae* Cas13b (PbCas13b).

233. The engineered CRISPR-Cas protein of any one of preceding statements comprising a mutation of an amino acid corresponding to amino acid R56 of *Prevotella buccae* Cas13b (PbCas13b).

234. The engineered CRISPR-Cas protein of any one of preceding statements comprising a mutation of an amino acid corresponding to amino acid N157 of *Prevotella buccae* Cas13b (PbCas13b).

235. The engineered CRISPR-Cas protein of any one of preceding statements comprising a mutation of an amino acid corresponding to amino acid H161 of *Prevotella buccae* Cas13b (PbCas13b).

236. The engineered CRISPR-Cas protein of any one of preceding statements comprising a mutation of an amino acid corresponding to amino acid H452 of *Prevotella buccae* Cas13b (PbCas13b).

237. The engineered CRISPR-Cas protein of any one of preceding statements comprising a mutation of an amino acid corresponding to amino acid N455 of *Prevotella buccae* Cas13b (PbCas13b).

238. The engineered CRISPR-Cas protein of any one of preceding statements comprising a mutation of an amino acid corresponding to amino acid K484 of *Prevotella buccae* Cas13b (PbCas13b).

239. The engineered CRISPR-Cas protein of any one of preceding statements comprising a mutation of an amino acid corresponding to amino acid N486 of *Prevotella buccae* Cas13b (PbCas13b).

240. The engineered CRISPR-Cas protein of any one of preceding statements comprising a mutation of an amino acid corresponding to amino acid G566 of *Prevotella buccae* Cas13b (PbCas13b).

241. The engineered CRISPR-Cas protein of any one of preceding statements comprising a mutation of an amino acid corresponding to amino acid H567 of *Prevotella buccae* Cas13b (PbCas13b).

242. The engineered CRISPR-Cas protein of any one of preceding statements comprising a mutation of an amino acid corresponding to amino acid A656 of *Prevotella buccae* Cas13b (PbCas13b).

243. The engineered CRISPR-Cas protein of any one of preceding statements comprising a mutation of an amino acid corresponding to amino acid V795 of *Prevotella buccae* Cas13b (PbCas13b).

244. The engineered CRISPR-Cas protein of any one of preceding statements comprising a mutation of an amino acid corresponding to amino acid A796 of *Prevotella buccae* Cas13b (PbCas13b).

245. The engineered CRISPR-Cas protein of any one of preceding statements comprising a mutation of an amino acid corresponding to amino acid W842 of *Prevotella buccae* Cas13b (PbCas13b).

246. The engineered CRISPR-Cas protein of any one of preceding statements comprising a mutation of an amino acid corresponding to amino acid K871 of *Prevotella buccae* Cas13b (PbCas13b).

247. The engineered CRISPR-Cas protein of any one of preceding statements comprising a mutation of an amino acid corresponding to amino acid E873 of *Prevotella buccae* Cas13b (PbCas13b).

248. The engineered CRISPR-Cas protein of any one of preceding statements comprising a mutation of an amino acid corresponding to amino acid R874 of *Prevotella buccae* Cas13b (PbCas13b).

249. The engineered CRISPR-Cas protein of any one of preceding statements comprising a mutation of an amino acid corresponding to amino acid R1068 of *Prevotella buccae* Cas13b (PbCas13b).

250. The engineered CRISPR-Cas protein of any one of preceding statements comprising a mutation of an amino acid corresponding to amino acid N1069 of *Prevotella buccae* Cas13b (PbCas13b).

251. The engineered CRISPR-Cas protein of any one of preceding statements comprising a mutation of an amino acid corresponding to amino acid H1073 of *Prevotella buccae* Cas13b (PbCas13b).

252. The engineered CRISPR-Cas protein of any one of preceding statements comprising one or more mutation of an amino acid corresponding to the following amino acids of *Leptotrichia* shahii Cas13a (LshCas13a): R597, N598, H602, R1278, N1279, or H1283.

253. The engineered CRISPR-Cas protein of any one of preceding statements comprising one or more mutation of an amino acid corresponding to the following amino acids of *Leptotrichia* shahii Cas13a (LshCas13a): R597, N598, H602, R1278, N1279, or H1283.

254. The engineered CRISPR-Cas protein of any one of preceding statements comprising in a HEPN domain one or more mutation of an amino acid corresponding to the following amino acids in a HEPN domain of *Leptotrichia* shahii Cas13a (LshCas13a): R597, N598, H602, R1278, N1279, or H1283.

255. The engineered CRISPR-Cas protein of any one of preceding statements comprising one or more mutation of an amino acid corresponding to the following amino acids of *Leptotrichia* shahii Cas13a (LshCas13a): R597, N598, or H602.

256. The engineered CRISPR-Cas protein of any one of preceding statements comprising in HEPN domain 1 one or more mutation of an amino acid corresponding to the following amino acids in HEPN domain 1 of *Leptotrichia* shahii Cas13a (LshCas13a): R597, N598, or H602.

257. The engineered CRISPR-Cas protein of any one of preceding statements comprising one or more mutation of an amino acid corresponding to the following amino acids of *Leptotrichia* shahii Cas13a (LshCas13a): R1278, N1279, or H1283.

258. The engineered CRISPR-Cas protein of any one of preceding statements comprising in HEPN domain 2 one or more mutation of an amino acid corresponding to the following amino acids in HEPN domain 2 of *Leptotrichia* shahii Cas13a (LshCas13a): R1278, N1279, or H1283.

259. The engineered CRISPR-Cas protein of any one of preceding statements comprising one or more mutation of an amino acid corresponding to the following amino acids of *Porphyromonas* gulae Cas13b (PguCas13b): R146, H151, R1116, or H1121.

260. The engineered CRISPR-Cas protein of any one of preceding statements comprising one or more mutation of an amino acid corresponding to the following amino acids of *Porphyromonas* gulae Cas13b (PguCas13b): R146, H151, R1116, or H1121.

261. The engineered CRISPR-Cas protein of any one of preceding statements comprising in a HEPN domain one or more mutation of an amino acid corresponding to the following amino acids in a HEPN domain of *Porphyromonas* gulae Cas13b (PguCas13b): R146, H151, R1116, or H1121.

262. The engineered CRISPR-Cas protein of any one of preceding statements comprising one or more mutation of an amino acid corresponding to the following amino acids of *Porphyromonas* gulae Cas13b (PguCas13b): R146 or H151.

263. The engineered CRISPR-Cas protein of any one of preceding statements comprising in HEPN domain 1 one or more mutation of an amino acid corresponding to the following amino acids in HEPN domain 1 of *Porphyromonas* gulae Cas13b (PguCas13b): R146 or H151.

264. The engineered CRISPR-Cas protein of any one of preceding statements comprising one or more mutation of an amino acid corresponding to the following amino acids of *Porphyromonas* gulae Cas13b (PguCas13b): R1116 or H1121.

265. The engineered CRISPR-Cas protein of any one of preceding statements comprising in HEPN domain 2 one or more mutation of an amino acid corresponding to the following amino acids in HEPN domain 2 of *Porphyromonas* gulae Cas13b (PguCas13b): R1116 or H1121.

266. The engineered CRISPR-Cas protein of any one of preceding statements comprising one or more mutation of an amino acid corresponding to the following amino acids of *Prevotella* sp. P5-125 Cas13b (PspCas13b): H133 or H1058.

267. The engineered CRISPR-Cas protein of any one of preceding statements comprising one or more mutation of an amino acid corresponding to the following amino acids of *Prevotella* sp. P5-125 Cas13b (PspCas13b): H133 or H1058.

268. The engineered CRISPR-Cas protein of any one of preceding statements comprising in a HEPN domain one or more mutation of an amino acid corresponding to the following amino acids in a HEPN domain of *Prevotella* sp. P5-125 Cas13b (PspCas13b): H133 or H1058.

269. The engineered CRISPR-Cas protein of any one of preceding statements comprising a mutation of an amino acid corresponding to amino acid H133 of *Prevotella* sp. P5-125 Cas13b (PspCas13b).

270. The engineered CRISPR-Cas protein of any one of preceding statements comprising in HEPN domain 1 a mutation of an amino acid corresponding to amino acid H133 in HEPN domain 1 of *Prevotella* sp. P5-125 Cas13b (PspCas13b).

271. The engineered CRISPR-Cas protein of any one of preceding statements comprising a mutation of an amino acid corresponding to amino acid H1058 of *Prevotella* sp. P5-125 Cas13b (PspCas13b).

272. The engineered CRISPR-Cas protein of any one of preceding statements comprising in HEPN domain 2 a mutation of an amino acid corresponding to the amino acid H1058 in HEPN domain 2 of *Prevotella* sp. P5-125 Cas13b (PspCas13b).

273. The engineered CRISPR-Cas protein of any of statements 8 to 272, wherein said amino acid is mutated to A, P, or V, preferably A.

274. The engineered CRISPR-Cas protein of any of statements 8 to 272, wherein said amino acid is mutated to a hydrophobic amino acid.

275. The engineered CRISPR-Cas protein of any of statements 8 to 272, wherein said amino acid is mutated to an aromatic amino acid.

276. The engineered CRISPR-Cas protein of any of statements 8 to 272, wherein said amino acid is mutated to a charged amino acid.

277. The engineered CRISPR-Cas protein of any of statements 8 to 272, wherein said amino acid is mutated to a positively charged amino acid.

278. The engineered CRISPR-Cas protein of any of statements 8 to 272, wherein said amino acid is mutated to a negatively charged amino acid.

279. The engineered CRISPR-Cas protein of any of statements 8 to 272, wherein said amino acid is mutated to a polar amino acid.

280. The engineered CRISPR-Cas protein of any of statements 8 to 272, wherein said amino acid is mutated to an aliphatic amino acid.

281. The engineered CRISPR-Cas protein of any one of preceding statements, wherein said Cas13 protein is or originates from a species of the genus *Alistipes, Anaerosalibacter, Bacteroides, Bacteroidetes, Bergeyella, Blautia, Butyrivibrio, Capnocytophaga, Carnobacterium, Chloroflexus, Chryseobacterium, Clostridium, Demequina, Eubacteriaceae, Eubacterium, Flavobacterium, Fusobacterium, Herbinix, Insolitispirillum, Lachnospiraceae, Leptotrichia, Listeria, Myroides, Paludibacter, Phaeodactylibacter, Porphyromonadaceae, Porphyromonas, Prevotella, Pseudobutyrivibrio, Psychroflexus, Reichenbachiella, Rhodobacter, Riemerella, Sinomicrobium, Thalassospira, Ruminococcus; preferably Leptotrichia shahii, Listeria seeligeri, Lachnospiraceae bacterium* (such as Lb MA2020, Lb NK4A179, Lb NK4A144), *Clostridium aminophilum* (such as Ca DSM 10710), *Carnobacterium gallinarum* (such as Cg DSM 4847), *Paludibacter propionicigenes* (such as Pp WB4), *Listeria weihenstephanensis* (such as Lw FSL R9-0317), *Listeriaceae bacterium* (such as Lb FSL M6-0635), *Leptotrichia wadei* (such as Lw F0279), *Rhodobacter capsulatus* (such as Rc SB 1003, Rc R121, Rc DE442), *Leptotrichia buccalis* (such as Lb C-1013-b), *Herbinix hemicellulosilytica, Eubacteriaceae bacterium* (such as Eb CHKCI004), *Blautia*. sp Marseille-P2398, *Leptotrichia* sp. oral taxon 879 str. F0557, *Chloroflexus aggregans, Demequina aurantiaca, Thalassospira* sp. TSL5-1, *Pseudobutyrivibrio* sp. OR37, *Butyrivibrio* sp. YAB3001, *Leptotrichia* sp. Marseille-P3007, *Bacteroides ihuae, Porphyromonadaceae bacterium* (such as Pb KH3CP3RA), *Listeria riparia, Insolitispirillum peregrinum, Alistipes* sp. ZOR0009, *Bacteroides pyogenes* (such as Bp F0041), *Bacteroidetes bacterium* (such as Bb GWA2_31_9), *Bergeyella zoohelcum* (such as Bz ATCC 43767), *Capnocytophaga canimorsus, Capnocytophaga cynodegmi, Chryseobacterium carnipullorum, Chryseobacterium jejuense, Chryseobacterium ureilyticum, Flavobacterium branchiophilum, Flavobacterium columnare, Flavobacterium* sp. 316, *Myroides odoratimimus* (such as Mo CCUG 10230, Mo CCUG 12901, Mo CCUG 3837), *Paludibacter propionicigenes, Phaeodactylibacter xiamenensis, Porphyromonas gingivalis* (such as Pg F0185, Pg F0568, Pg JCVI SC001, Pg W4087, *Porphyromonas gulae, Porphyromonas* sp. COT-052 OH4946, *Prevotella aurantiaca, Prevotella buccae* (such as Pb ATCC 33574), *Prevotella falsenii, Prevotella intermedia* (such as Pi 17, Pi ZT), *Prevotella pallens* (such as Pp ATCC 700821), *Prevotella pleuritidis, Prevotella saccharolytica* (such as Ps F0055), *Prevotella* sp. MA2016, *Prevotella* sp. MSX73, *Prevotella* sp. P4-76, *Prevotella* sp. P5-119, *Prevotella* sp. P5-125, *Prevotella* sp. P5-60, *Psychroflexus torquis, Reichenbachiella agariperforans, Riemerella anatipestifer, Sinomicrobium oceani, Fusobacterium necrophorum* (such as Fn subsp. *funduliforme* ATCC 51357, Fn DJ-2, Fn BFTR-1, Fn subsp. *Funduliforme*), *Fusobacterium perfoetens* (such as Fp ATCC 29250), *Fusobacterium ulcerans* (such as Fu ATCC 49185), *Anaerosalibacter* sp. ND1, *Eubacterium siraeum, Ruminococcus flavefaciens* (such as Rfx XPD3002), or *Ruminococcus albus.*

282. The engineered CRISPR-Cas protein of any one of preceding statements, wherein said Cas13 protein is a Cas13a protein.

283. The engineered CRISPR-Cas protein of statement 282, wherein said Cas13a protein is or originates from a species of the genus *Bacteroides, Blautia, Butyrivibrio, Carnobacterium, Chloroflexus, Clostridium, Demequina, Eubacterium, Herbinix, Insolitispirillum, Lachnospiraceae, Leptotrichia, Listeria, Paludibacter, Porphyromonadaceae, Pseudobutyrivibrio, Rhodobacter*, or *Thalassospira*; preferably *Leptotrichia shahii, Listeria seeligeri, Lachnospiraceae bacterium* (such as Lb MA2020, Lb NK4A179, Lb NK4A144), *Clostridium aminophilum* (such as Ca DSM 10710), *Carnobacterium gallinarum* (such as Cg DSM 4847), *Paludibacter propionicigenes* (such as Pp WB4), *Listeria weihenstephanensis* (such as Lw FSL R9-0317), *Listeriaceae bacterium* (such as Lb FSL M6-0635), *Leptotrichia wadei* (such as Lw F0279), *Rhodobacter capsulatus* (such as Rc SB 1003, Rc R121, Rc DE442), *Leptotrichia buccalis* (such as Lb C-1013-b), *Herbinix hemicellulosilytica, Eubacteriaceae bacterium* (such as Eb CHKCI004), *Blautia*. sp Marseille-P2398, *Leptotrichia* sp. oral taxon 879 str. F0557, *Chloroflexus aggregans, Demequina aurantiaca, Thalassospira* sp. TSL5-1, *Pseudobutyrivibrio* sp. OR37, *Butyrivibrio* sp. YAB3001, *Leptotrichia* sp. Marseille-P3007, *Bacteroides ihuae, Porphyromonadaceae bacterium* (such as Pb KH3CP3RA), *Listeria riparia*, or *Insolitispirillum peregrinum.*

284. The engineered CRISPR-Cas protein of any one of preceding statements, wherein said Cas13 protein is a Cas13b protein.

285. The engineered CRISPR-Cas protein of statement 284, wherein said Cas13b protein is or originates from a species of the genus *Alistipes, Bacteroides, Bacteroidetes, Bergeyella, Capnocytophaga, Chryseobacterium, Flavobacterium, Myroides, Paludibacter, Phaeodactylibacter, Porphyromonas, Prevotella, Psychroflexus, Reichenbachiella, Riemerella*, or *Sinomicrobium*; preferably *Alistipes* sp. ZOR0009, *Bacteroides pyogenes* (such as Bp F0041), *Bacteroidetes bacterium* (such as Bb GWA2_31_9), *Bergeyella zoohelcum* (such as Bz ATCC 43767), *Capnocytophaga canimorsus, Capnocytophaga cynodegmi, Chryseobacterium carnipullorum, Chryseobacterium jejuense, Chryseobacterium ureilyticum, Flavobacterium branchiophilum, Flavobacterium columnare, Flavobacterium* sp. 316, *Myroides odoratimimus* (such as Mo CCUG 10230, Mo CCUG 12901, Mo CCUG 3837), *Paludibacter propionicigenes, Phaeodactylibacter xiamenensis, Porphyromonas gingivalis* (such as Pg F0185, Pg F0568, Pg JCVI SC001, Pg W4087, *Porphyromonas gulae, Porphyromonas* sp. COT-052 OH4946, *Prevotella aurantiaca, Prevotella buccae* (such as Pb ATCC 33574), *Prevotella falsenii, Prevotella intermedia* (such as Pi 17, Pi ZT), *Prevotella pallens* (such as Pp ATCC 700821), *Prevotella pleuritidis, Prevotella saccharolytica* (such as Ps F0055), *Prevotella* sp. MA2016, *Prevotella* sp. MSX73, *Prevotella* sp. P4-76, *Prevotella* sp. P5-119, *Prevotella* sp. P5-125, *Prevotella* sp. P5-60, *Psychroflexus torquis, Reichenbachiella agariperforans, Riemerella anatipestifer*, or *Sinomicrobium oceani.*

286. The engineered CRISPR-Cas protein any one of preceding statements, wherein said Cas13 protein is a Cas13c protein.

287. The engineered CRISPR-Cas protein of statement 286, wherein said Cas13c protein is or originates from a species of the genus *Fusobacterium* or *Anaerosalibacter*; preferably *Fusobacterium necrophorum* (such as Fn subsp. *funduliforme* ATCC 51357, Fn DJ-2, Fn BFTR-1, Fn subsp. *Funduliforme*), *Fusobacterium perfoetens* (such as Fp ATCC 29250), *Fusobacterium ulcerans* (such as Fu ATCC 49185), or *Anaerosalibacter* sp. ND1.

288. The engineered CRISPR-Cas protein of any one of preceding statements, wherein said Cas13 protein is a Cas13d protein.

289. The engineered CRISPR-Cas protein of statement 288, wherein said Cas13d protein is originates from a species of the genus *Eubacterium* or *Ruminococcus*, preferably *Eubacterium siraeum, Ruminococcus flavefaciens* (such as Rfx XPD3002), or *Ruminococcus albus.*

290. The engineered CRISPR-Cas protein of any one of preceding statements, wherein catalytic activity of the engineered CRISPR-Cas protein is increased as compared to a corresponding wildtype CRISPR-Cas protein.

291. The engineered CRISPR-Cas protein of any one of preceding statements, wherein catalytic activity of the engineered CRISPR-Cas protein is decreased as compared to a corresponding wildtype CRISPR-Cas protein.

292. The engineered CRISPR-Cas protein of any one of preceding statements, wherein gRNA binding of the engineered CRISPR-Cas protein is increased as compared to a corresponding wildtype CRISPR-Cas protein.

293. The engineered CRISPR-Cas protein of any one of preceding statements, wherein gRNA binding of the engineered CRISPR-Cas protein is decreased as compared to a corresponding wildtype CRISPR-Cas protein.

294. The engineered CRISPR-Cas protein of any one of preceding statements, wherein specificity of the CRISPR-Cas protein is increased as compared to a corresponding wildtype CRISPR-Cas protein.

295. The engineered CRISPR-Cas protein of any one of preceding statements, wherein specificity of the CRISPR-Cas protein is decreased as compared to a corresponding wildtype CRISPR-Cas protein.

296. The engineered CRISPR-Cas protein of any one of preceding statements, wherein stability of the CRISPR-Cas protein is increased as compared to a corresponding wildtype CRISPR-Cas protein.

297. The engineered CRISPR-Cas protein of any one of preceding statements, wherein stability of the CRISPR-Cas protein is decreased as compared to a corresponding wildtype CRISPR-Cas protein.

298. The engineered CRISPR-Cas protein of any one of preceding statements, further comprising one or more mutations which inactivate catalytic activity.

299. The engineered CRISPR-Cas protein of any one of preceding statements, wherein off-target binding of the CRISPR-Cas protein is increased as compared to a corresponding wildtype CRISPR-Cas protein.
300. The engineered CRISPR-Cas protein of any one of preceding statements, wherein off-target binding of the CRISPR-Cas protein is decreased as compared to a corresponding wildtype CRISPR-Cas protein.
301. The engineered CRISPR-Cas protein of any one of preceding statements, wherein target binding of the CRISPR-Cas protein is increased as compared to a corresponding wildtype CRISPR-Cas protein.
302. The engineered CRISPR-Cas protein of any one of preceding statements, wherein target binding of the CRISPR-Cas protein is decreased as compared to a corresponding wildtype CRISPR-Cas protein.
303. The engineered CRISPR-Cas protein of any one of preceding statements, wherein the engineered CRISPR-Cas protein has a higher protease activity or polynucleotide-binding capability compared to a corresponding wildtype CRISPR-Cas protein.
304. The engineered CRISPR-Cas protein of any one of preceding statements, wherein PFS recognition is altered as compared to a corresponding wildtype CRISPR-Cas protein.
305. The engineered CRISPR-Cas protein of any one of preceding statements, further comprising a functional heterologous domain.
306. The engineered CRISPR-Cas protein of any one of preceding statements, further comprising an NLS.
307. The engineered CRISPR-Cas protein of any one of preceding statements, further comprising a NES.
308. An engineered CRISPR-Cas protein comprising one or more HEPN domains and is less than 1000 amino acids in length.
309. The engineered CRISPR-Cas protein of statement 308, wherein the protein is less than 950, less than 900, less than 850, less than 800, less, or than 750 amino acids in size.
310. The engineered CRISPR-Cas protein of statement 308 or 309, wherein the HEPN domain comprises a RxxxxH motif.
311. The engineered CRISPR-Cas protein of statement 310, wherein the RxxxxH motif comprises a R[N/H/K]$X_1X_2X_3$H sequence.
312. The engineered CRISPR-Cas protein of statement 311, wherein: $X_1$ is R, S, D, E, Q, N, G, or Y; $X_2$ is independently I, S, T, V, or L; and $X_3$ is independently L, F, N, Y, V, I, S, D, E, or A.
313. The engineered CRISPR-Cas protein of any one of statements 308-313, wherein the CRISPR-Cas protein is a Type VI CRISPR Cas protein.
314. The engineered CRISPR Cas protein of statement 313, wherein the Type VI CRISPR Cas protein is a Cas13a, a Cas13b, a Cas13c, or a Cas13d.
315. The engineered CRISPR-Cas protein of any one of statements 308 to 315, wherein the CRISPR-Cas protein is associated with a functional domain.
316. The engineered CRISPR-Cas protein of any one of statements 308 to 316, wherein the CRISPR-Cas protein comprises one or more mutations equivalent to mutations in any one of statements [1386]57-81386] 329.
317. The engineered CRISPR-Cas protein of statement 316, wherein the CRISPR-Cas protein comprises one or more mutations in the helical domain.
318. The engineered CRISPR-Cas protein of any one of statements 308 to 318, wherein the CRISPR-Cas protein is in a dead form or has nickase activity.
319. A polynucleotide encoding the engineered CRISPR-Cas protein of any of statements 1 to 318.
320. The polynucleotide according to statement 319, which is codon optimized.
321. A CRISPR-Cas system comprising the engineered CRISPR-Cas protein of any of statements 1 to [1386] 367, or the polynucleotide of statement 318 or 319, and a nucleotide component capable of forming a complex with the engineered CRISPR-Cas protein and able to hybridize with a target nucleic acid sequence and direct sequence-specific binding of said complex to the target nucleic acid sequence.
322. A vector system comprising one or more vectors, the one or more vectors comprising one or more polynucleotide molecules encoding components of the engineered CRISPR-Cas protein of statement 321.
323. A method of modifying a target nucleic acid comprising: introducing in a cell or organism that comprises the target nucleic acid, the engineered CRISPR-Cas protein according to any of statements 1 to 318, the polynucleic acid according to statement 319 or 320, the CRISPR-Cas system according to statement 321, or the vector or vector system according to statement 322, such that the engineered CRISPR-Cas protein modifies the target nucleic acid in the cell or organism.
324. The method of statement [1386]372, wherein the engineered CRISPR-Cas system is introduced via delivery by liposomes, nanoparticles, exosomes, microvesicles, nucleic acid nanoassemblies, a gene gun, an implantable device, or the vector system of statement 322.
325. The method of statement 323 or 324, wherein the engineered CRISPR-cas protein is associated with one or more functional domains.
326. The method of any one of statements 323 to 325, wherein the target nucleic acid comprises a genomic locus, and the engineered CRISPR-Cas protein modifies gene product encoded at the genomic locus or expression of the gene product.
327. The method of any one of statements 323 to 326, wherein the target nucleic acid is DNA or RNA and wherein one or more nucleotides in the target nucleic acid are base edited.
328. The method of any one of statements 323 to 327, wherein the target nucleic acid is DNA or RNA and wherein the target nucleic acid is cleaved.
329. The method of statement 328, wherein the engineered CRISPR-Cas protein further cleaves non-target nucleic acid.
330. The method of statement 328 or 329, further comprising visualizing activity and, optionally, using a detectable label.
331. The method of any one of statements 328 to 330, further comprising detecting binding of one or more components of the CRISPR-Cas system to the target nucleic acid.
332. The method of any one of statements 328 to 331, wherein said cell or organisms is a eukaryotic cell or organism.
333. The method of any one of statements 328 to 332, wherein said cell or organisms is an animal cell or organism.

334. The method of any one of statements 328 to 333, wherein said cell or organisms is a plant cell or organism.

335. A method for detecting a target nucleic acid in a sample comprising: contacting a sample with: an engineered CRISPR-Cas protein of any one of statements 1 to 318; at least one guide polynucleotide comprising a guide sequence capable of binding to the target nucleic acid and designed to form a complex with the engineered CRISPR-Cas; and a RNA-based masking construct comprising a non-target sequence; wherein the engineered CRISPR-Cas protein exhibits collateral RNase activity and cleaves the non-target sequence of the detection construct; and detecting a signal from cleavage of the non-target sequence, thereby detecting the target nucleic acid in the sample.

336. The method of statement 335, further comprising contacting the sample with reagents for amplifying the target nucleic acid.

337. The method of statement 336, wherein the reagents for amplifying comprises isothermal amplification reaction reagents.

338. The method of statement 337, wherein the isothermal amplification reagents comprise nucleic-acid sequence-based amplification, recombinase polymerase amplification, loop-mediated isothermal amplification, strand displacement amplification, helicase-dependent amplification, or nicking enzyme amplification reagents.

339. The method of any one of statements 335 to 338, wherein the target nucleic acid is DNA molecule and the method further comprises contacting the target DNA molecule with a primer comprising an RNA polymerase site and RNA polymerase.

340. The method of any one of statements 335 to 339, wherein the masking construct: suppresses generation of a detectable positive signal until the masking construct cleaved or deactivated, or masks a detectable positive signal or generates a detectable negative signal until the masking construct cleaved or deactivated.

341. The method of any one of statements 335 to 340, wherein the masking construct comprises: a. a silencing RNA that suppresses generation of a gene product encoded by a reporting construct, wherein the gene product generates the detectable positive signal when expressed; b. a ribozyme that generates the negative detectable signal, and wherein the positive detectable signal is generated when the ribozyme is deactivated; c. a ribozyme that converts a substrate to a first color and wherein the substrate converts to a second color when the ribozyme is deactivated; d. an aptamer and/or comprises a polynucleotide-tethered inhibitor; e. a polynucleotide to which a detectable ligand and a masking component are attached; f. a nanoparticle held in aggregate by bridge molecules, wherein at least a portion of the bridge molecules comprises a polynucleotide, and wherein the solution undergoes a color shift when the nanoparticle is disbursed in solution; g. a quantum dot or fluorophore linked to one or more quencher molecules by a linking molecule, wherein at least a portion of the linking molecule comprises a polynucleotide; h. a polynucleotide in complex with an intercalating agent, wherein the intercalating agent changes absorbance upon cleavage of the polynucleotide; or 1. two fluorophores tethered by a polynucleotide that undergo a shift in fluorescence when released from the polynucleotide.

342. The method of statement 341, wherein the aptamer: a. comprises a polynucleotide-tethered inhibitor that sequesters an enzyme, wherein the enzyme generates a detectable signal upon release from the aptamer or polynucleotide-tethered inhibitor by acting upon a substrate; or b. is an inhibitory aptamer that inhibits an enzyme and prevents the enzyme from catalyzing generation of a detectable signal from a substrate or wherein the polynucleotide-tethered inhibitor inhibits an enzyme and prevents the enzyme from catalyzing generation of a detectable signal from a substrate; or c. sequesters a pair of agents that when released from the aptamers combine to generate a detectable signal.

343. The method of statement 341 or 342, wherein the nanoparticle is a colloidal metal.

344. The method of any one of statements 335 to 343, wherein the at least one guide polynucleotide comprises a mismatch.

345. The method of statement 344, wherein the mismatch is up- or downstream of a single nucleotide variation on the one or more guide sequences.

346. A cell or organism comprising the engineered CRISPR-Cas protein according to any of statements 1 to 318, the polynucleic acid according to statement 319 or 320, the CRISPR-Cas system according to statement 321, or the vector or vector system according to statement 322.

347. An engineered adenosine deaminase comprising one or more mutations, wherein the engineered adenosine deaminase has cytidine deaminase activity.

348. The engineered adenosine deaminase of statement 347, wherein the engineered adenosine deaminase has adenosine deaminase activity.

349. The engineered adenosine deaminase of statement 347 or 348, wherein the engineered adenosine deaminase is a portion of a fusion protein.

350. The engineered adenosine deaminase of statement 349, wherein the fusion protein comprises a functional domain.

351. The engineered adenosine deaminase of statement 350, wherein the functional domain is capable of directing the engineered adenosine deaminase to bind to a target nucleic acid.

352. The engineered adenosine deaminase of statement 350 or 351, wherein the functional domain is a CRISPR-Cas protein of any one of statements 1 to 318.

353. The engineered adenosine deaminase of statement 352, wherein the CRISPR-Cas protein is a dead form CRISPR-Cas protein or CRISPR-Cas nickase protein.

354. The engineered adenosine deaminase of any one of statements 347 to 353, wherein the one or more mutations comprises: E488Q, V351G, S486A, T375S, S370C, P462A, N597I, L332I, I398V, K350I, M383L, D619G, S582T, V440I, S495N, K418E, S661T based on amino acid sequence positions of hADAR2-D, and corresponding mutations in a homologous ADAR protein.

355. The engineered adenosine deaminase of any one of statements 347 to 354, wherein the one or more mutations comprises: E488Q, V351G, S486A, T375S, S370C, P462A, N597I, L332I, I398V, K350I, M383L, D619G, S582T, V440I, S495N, K418E, and S661T based on amino acid sequence positions of hADAR2-D, and corresponding mutations in a homologous ADAR protein.

356. A polynucleotide encoding the engineered adenosine deaminase of any one of statements 347-355, or a catalytic domain thereof.
357. A vector comprising the polynucleotide of statement 356.
358. A pharmaceutical composition comprising the engineered adenosine deaminase of any one of statements 347-355 or a catalytic domain thereof formulated for delivery by liposomes, nanoparticles, exosomes, microvesicles, nucleic acid nanoassemblies, a gene gun, or an implantable device.
359. An engineered cell expressing the engineered adenosine deaminase of any one of any one of statements 347-355 or a catalytic domain thereof.
360. The engineered cell of statement 359, wherein the cell transiently expresses the engineered adenosine deaminase or the catalytic domain thereof.
361. The engineered cell of statement 359 or 360, wherein the cell non-transiently expresses the engineered adenosine deaminase or the catalytic domain thereof.
362. An engineered, non-naturally occurring system for modifying nucleotides in a target nucleic acid, comprising: a) a dead CRISPR-Cas or CRISPR-Cas nickase protein, or a nucleotide sequence encoding said dead Cas or Cas nickase protein; b) a guide molecule comprising a guide sequence that hybridizes to a target sequence and designed to form a complex with the dead CRISPR-Cas or CRISPR-Cas nickase protein; and c) a nucleotide deaminase protein or catalytic domain thereof, or a nucleotide sequence encoding said nucleotide deaminase protein or catalytic domain thereof, wherein said nucleotide deaminase protein or catalytic domain thereof is covalently or non-covalently linked to said dead CRISPR-Cas or CRISPR-Cas nickase protein or said guide molecule is adapted to link thereof after delivery.
363. The system of statement 362, wherein said adenosine deaminase protein or catalytic domain thereof comprises one or more of the mutations: E488Q, V351G, S486A, T375S, S370C, P462A, N597I, L332I, I398V, K350I, M383L, D619G, S582T, V440I, S495N, K418E, S661T based on amino acid sequence positions of hADAR2-D, and corresponding mutations in a homologous ADAR protein.
364. The system of statement 362 or 363, wherein said adenosine deaminase protein or catalytic domain thereof comprises mutations: E488Q, V351G, S486A, T375S, S370C, P462A, N597I, L332I, I398V, K350I, M383L, D619G, S582T, V440I, S495N, K418E, and S661T based on amino acid sequence positions of hADAR2-D, and corresponding mutations in a homologous ADAR protein.
365. The system of any one of statements 362 to 364, wherein the CRISPR-Cas protein is Cas9, Cas12, Cas13, Cas 14, CasX, CasY.
366. The system of any one of statements 362 to 365, wherein the CRISPR-Cas protein is Cas13b.
367. The system of any one of statements 362 to 366, wherein the CRISPR-Cas protein is Cas13b-t1, Cas13b-t2, or Cas13b-t3.
368. The system of any one of statements 362 to 367, wherein the CRISPR-Cas is an engineered CRISPR-Cas protein of any one of statements 1 to 318.
369. A method for modifying nucleotide in a target nucleic acid, comprising: delivering to said target nucleic acid the engineered adenosine deaminase of any one of statements 347-355, or the system of any one of statements 362-368, wherein the deaminase deaminates a nucleotide at one or more target loci on the target nucleic acid.
370. The method of statement 369, wherein said nucleotide deaminase protein or catalytic domain thereof has been modified to increase activity against a DNA-RNA heteroduplex.
371. The method of statement 369 or 370, wherein said nucleotide deaminase protein or catalytic domain thereof has been modified to reduce off-target effects.
372. The method of any one of statements 369 to 371, wherein the target nucleic acid is within a cell.
373. The method of statement 372, wherein said cell is a eukaryotic cell.
374. The method of statement 372 or 373, wherein said cell is a non-human animal cell.
375. The method of any one of statements 372 to 374, wherein said cell is a human cell.
376. The method of any one of statements 372 to 375, wherein said cell is a plant cell.
377. The method of any one of statements 369 to 376, wherein said target nucleic acid is within an animal.
378. The method of any one of statements 369 to 377, wherein said target nucleic acid is within a plant.
379. The method of any one of statements 369 to 378, wherein said target nucleic acid is comprised in a DNA molecule in vitro.
380. The method of any one of statements 369 to 379, wherein the engineered adenosine deaminase, or one or more components of the system are delivered to the cell as a ribonucleoprotein complex.
381. The method of statement 380, wherein the engineered adenosine deaminase, or one or more components of the system are delivered via one or more particles, one or more vesicles, or one or more viral vectors.
382. The method of statement 381, wherein said one or more particles comprise a lipid, a sugar, a metal or a protein.
383. The method of statement 381 or 382, wherein said one or more particles comprise lipid nanoparticles.
384. The method of any one of statements 381 to 383, wherein said one or more vesicles comprise exosomes or liposomes.
385. The method of any one of statements 381 to 384, wherein said one or more viral vectors comprise one or more adenoviral vectors, one or more lentiviral vectors, or one or more adeno-associated viral vectors.
386. The method of any one of statements 369 to 385, where said method modifies a cell, a cell line or an organism by manipulation of one or more target sequences at genomic loci of interest.
387. The method of statement 386, wherein said deamination of said nucleotide at said target locus of interest remedies a disease caused by a G→A or C→T point mutation or a pathogenic SNP.
388. The method of statement 387, wherein said disease is selected from cancer, haemophilia, beta-thalassemia, Marfan syndrome and Wiskott-Aldrich syndrome.
389. The method of statement 386, 387, or 388, wherein said deamination of said nucleotide at said target locus of interest remedies a disease caused by a T→C or A→G point mutation or a pathogenic SNP.
390. The method of statement 389, wherein said deamination of said nucleotide at said target locus of interest inactivates a target gene at said target locus.

391. The method of any one of statements 380 to 390, wherein the engineered adenosine deaminase, or one or more components of the system are delivered by liposomes, nanoparticles, exosomes, microvesicles, nucleic acid nanoassemblies, a gene gun, an implantable device, or the vector system of statement 302.
392. The method of any one of statements 369 to 392, wherein modification of the nucleotide modifies gene product encoded at the target locus or expression of the gene product.
393. The engineered adenosine deaminase of any one of statements 347-355 or the system of any one of statements 362-368, wherein the adenosine protein or catalytic domain thereof comprises a mutation on S375 based on amino acid sequence positions of hADAR2-D, and a corresponding mutation in a homologous ADAR protein.
394. The engineered adenosine deaminase or the system of statement 393, wherein the mutation on S375 is S375N.
395. The use of the engineered CRISPR-Cas protein or engineered adenosine deaminase of any one of the preceding statements for the preparation of a medicament for the treatment of a disease.
396. A pharmaceutical formulation comprising the engineered CRISPR-Cas protein or engineered adenosine deaminase of any one of the preceding statements for use as a medicament.

The invention is further described in the following examples, which do not limit the scope of the invention described in the claims.

EXAMPLES

Example 1—Crystal Structure of Cas13b in Complex with crRNA

Methods

Protein Purification for Crystallization

PbuCas13b was expressed in a pET28 based vector with a twin-strep-sumo tag fused at the N-terminal in chemically competent BL21 DE3 cells purchased from New England Biolabs. Cells with the expression plasmid were grown at 37 degrees to OD 0.2 then the temperature was switched to 21 degrees. Growth was continued until OD 0.6 then induced with 5 μM IPTG. Cultures were grown for 18-20 hours, and then cells were harvested by centrifugation at 5,000 rpm and frozen at −80° C. Frozen cell paste was homogenized in Buffer A (500 mM Sodium Chloride, 50 mM Hepes pH 7.5, 2 mM DTT) supplemented with benzonase and lysozyme. The cells were broken by two passes through a microfluidizer at 20,000 psi and cell debris were separated from the soluble fraction by centrifugation at 10,000 rpm. The soluble fraction was passed through Streptactin resin (GE life sciences) and washed with 10 column volumes of Buffer A, followed by 10 column volume of wash buffer (1 M Sodium chloride, 50 mM Hepes 7.5, 2 mM DTT), and finally by 10 column volumes of Cleavage Buffer (400 mM Sodium Chloride, 20 mM Hepes 7.5, 2 mM DTT). PbuCas13b was eluted from the resin by addition of 5 mM desthiobiotin (Sigma), then cleaved overnight by sumo protease after being supplemented with 20 mM DTT. After cleavage the protein was passed through a Heparin column, concentrated to 500 μL and passed over a superdex 200 column (GE life sciences) equilibrated in storage buffer (500 mM Sodium Chloride, 10 mM Hepes pH 7.0, 2 mM DTT). Peak fractions were pooled and concentrated to at least 20 mg/ml. Selenomethionine protein was similarly purified except with 5 mM DTT being supplemented in each buffer. Protein was quantified using Pierce reagent (Thermo).

Crystallization and Data Collection

RNA substrate was added to PbuCas13b protein at 2:1 molar ratio and dialyzed for 7 hours against dialysis buffer (50 mM Sodium Chloride, 10 mM Hepes 7.0, 2 mM TCEP). Complexed PbuCas13b+RNA were diluted to 10 mg/ml with dialysis buffer and set up at 20 degrees by hanging drop vapor diffusion against 165 mM Sodium Citrate pH 4.6, 5.5% PEG6000, and 2 mM TCEP at varying drop ratios. Rod shaped crystals grew overnight and reached full size in 1-2 months. Crystals were transferred from the drop to cryo stabilization buffer (140 mM Sodium Citrate pH 4.6, 5% PEG6000, 35% PEG400), soaked for up to 24 hours, then flash frozen in liquid nitrogen. Selenium crystals for phasing were grown in similar conditions supplemented with 5 mM TCEP.

Native diffraction data from crystals of PbuCas13b and guide RNA were collected at the Advanced Photon Source, Argonne National Labs on beamlines 23-ID-B/D, and anomalous data at the Diamond light source on beamline 104. A small beam was used, either collimated (23-ID) or focused (Diamond) to 20 microns, and multiple datasets were collected along the length of the crystal. Anomalous datasets were collected at 0.97934 (peak), 0.97958 (inflection) and 0.97204 (remote) angstrom wavelengths. Diffraction data were processed using XDS (1, 2) and scaled in aimless (3) implemented in autoPROC toolbox (4). The statistics are summarized in Table 10 below.

TABLE 10

| Data name | PbuCas13b-Se-peak | PbuCas13b-Se-inflection | PbuCas13b-Se-remote | PbuCas13b-native |
|---|---|---|---|---|
| Ligand in the structure | Citrate | Citrate | Citrate | Citrate |
| Data collection | | | | |
| Space group | $P2_12_12_1$ | $P2_12_12_1$ | $P2_12_12_1$ | $P2_12_12_1$ |
| Cell dimensions | | | | |
| a, b, c (Å) | 90.82, 124.65, 140.73 | 90.86 124.72 140.77 | 90.88, 124.76, 140.79 | 90.86, 125.03, 140.57 |
| α, β, γ (°) | 90, 90, 90 | 90, 90, 90 | 90, 90, 90 | 90, 90, 90 |
| Wavelength (Å) | 0.97934 | 0.97958 | 0.97204 | 1.03320 |
| Resolution (Å) | 140.73-2.32 (2.47-2.32)* | 140.77-2.35 (2.53-2.35)* | 140.79-2.40 (2.62-2.40)* | 93.42-1.97 (2.07-1.97)* |
| Unique reflections | 59325 | 55600 | 50274 | 111373 |
| $R_{sym}$ | 0.203 (1.732)* | 0.207 (1.688)* | 0.214 (1.741)* | 0.245 (2.754)* |
| I/σ(I) | 10.2 (1.4)* | 10.4 (1.5)* | 10.1 (1.5)* | 10.4 (1.8)* |
| CC1/2 | 0.996 (0.7)* | 0.996 (0.710)* | 0.996 (0.706)* | 0.995 (0.572)* |
| Completeness (%) | 94.2 (55.8)* | 94.0 (56.6)* | 93.8 (52.0)* | 97.8 (99.2) |
| Redundancy | 13.6 (12.3)* | 13.5 (12.5)* | 13.5 (12.7)* | 13.3 (14.1)* |

TABLE 10-continued

| Data name | PbuCas13b-Se-peak | PbuCas13b-Se-inflection | PbuCas13b-Se-remote | PbuCas13b-native |
|---|---|---|---|---|
| Refinement | | | | |
| $R_{work}/R_{free}$** | | | | 0.1700/0.2023 |
| No. atoms | | | | |
| Protein | | | | 9111 |
| Ligands | | | | 41 |
| Water | | | | 657 |
| B-factors (Å$^2$) | | | | |
| Protein | | | | 39.06 |
| Ligands | | | | 58.91 |
| Water | | | | 40.20 |
| R.m.s deviations | | | | |
| Bond lenghts (Å) | | | | 0.005 |
| Bond angles (°) | | | | 0.742 |
| Ramachandran analysis[#] (%) | | | | |
| Favored | | | | 97.01 |
| Allowed | | | | 2.70 |
| Outliers | | | | 0.29 |

*Highest resolution shell is shown in parenthesis.
**Rfree was calculated with 5% of the data.
[#]Distribution of dihedral angles in Ramachandran diagram were calculated with MolProbity program (1).
Reference: 1. V. B. Chen et al., MolProbity: all-atom structure validation for macromolecular crystallography. Acta Crystallographica Section D-Biological Crystalloography 66, 12-21 (2010).
Structure solution The crystal structure of PbuCas13b was solved by multiwavelength anomalous diffraction (MAD) using selenium as anomalous scattering. The position of 27 SeMet sites were determined and refined using phenix.autosol (5, 6). A partial model was built by phenix.autobuild (7) using a 3.5 Å resolution experimental map with a figure of merit of 0.35. Cycles of manual rebuilding in Coot (8, 9) and refinement in phenix.refine (10-12) were done using the selenium experimental map. R-free flags and experimental phases were transferred from the selenium data to high-resolution native data using reflection file editor in PHENIX. These reflections were used for further cycles of rebuilding in Coot and refinement in phenix.refine. Anomalous difference maps were used to ensure correct registry. Refinement in phenix.refine used TLS (translation, libration, and screw), and positional and individual B-factor refinement. Citrate restrains were generated by phenix.elbow (13). The final model contains one polypeptide chain, one RNA nucleotide chain, two citrates molecules, one tetraethylene glycol (PG4) molecule, two Cl atoms, and 657 water molecules. Figures were created with PyMol Software (14).

Structure Analysis

RNA structure was analyzed using DSSR (15). Protein conservation mapping to the structure was done using the Consurf server (16). Protein secondary structure was analyzed using the PDBSUM webserver (17). APBS as part of the PyMol visualization program was used to calculate electrostatics (18).

Protein Alignment

Figure 14:
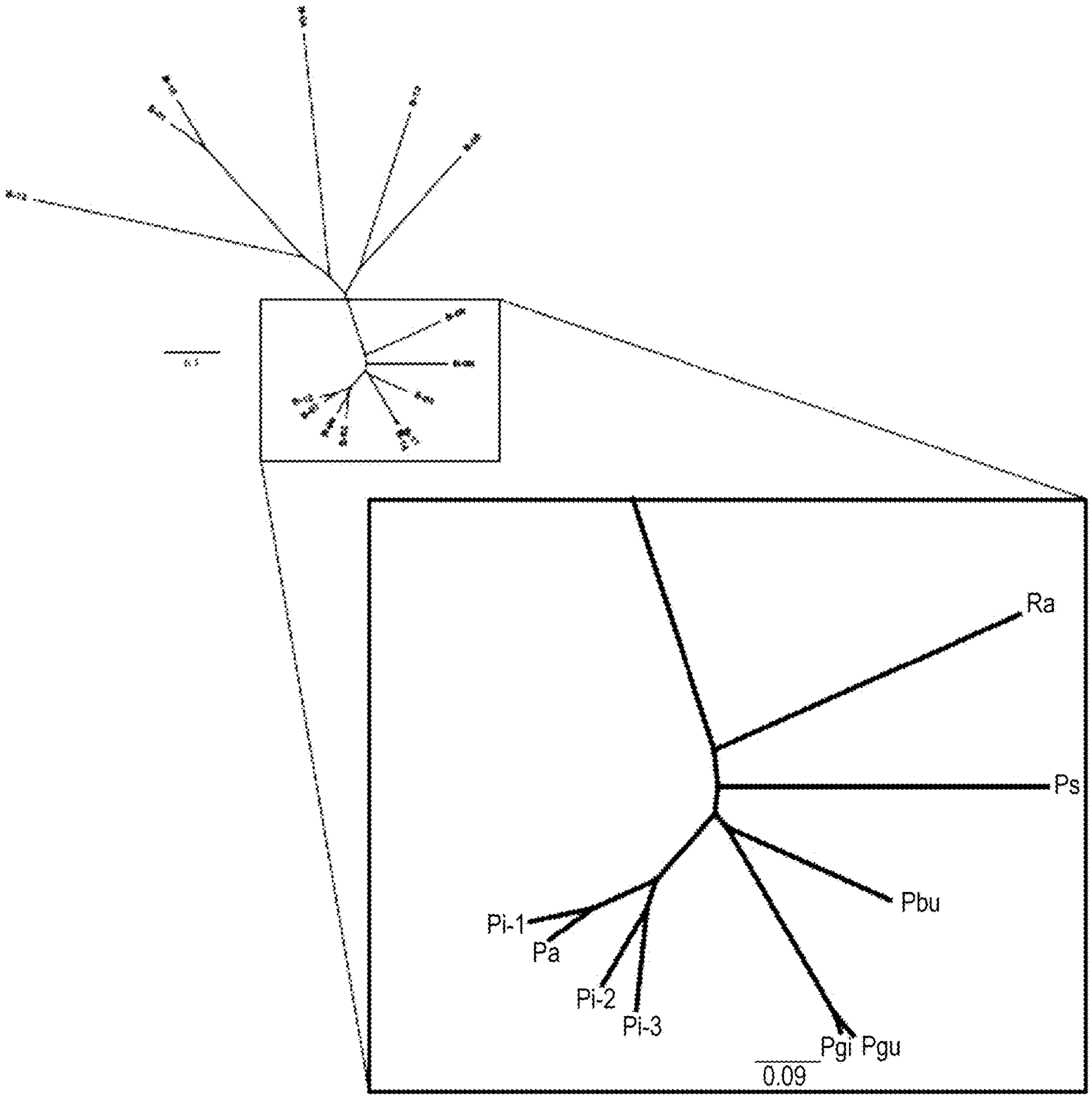
FIG. 14. Cas13b Neighbor-joining tree of all Cas13b family members. Inset, Cas13b subset with PbuCas13b (bolded).
Figure 15A:
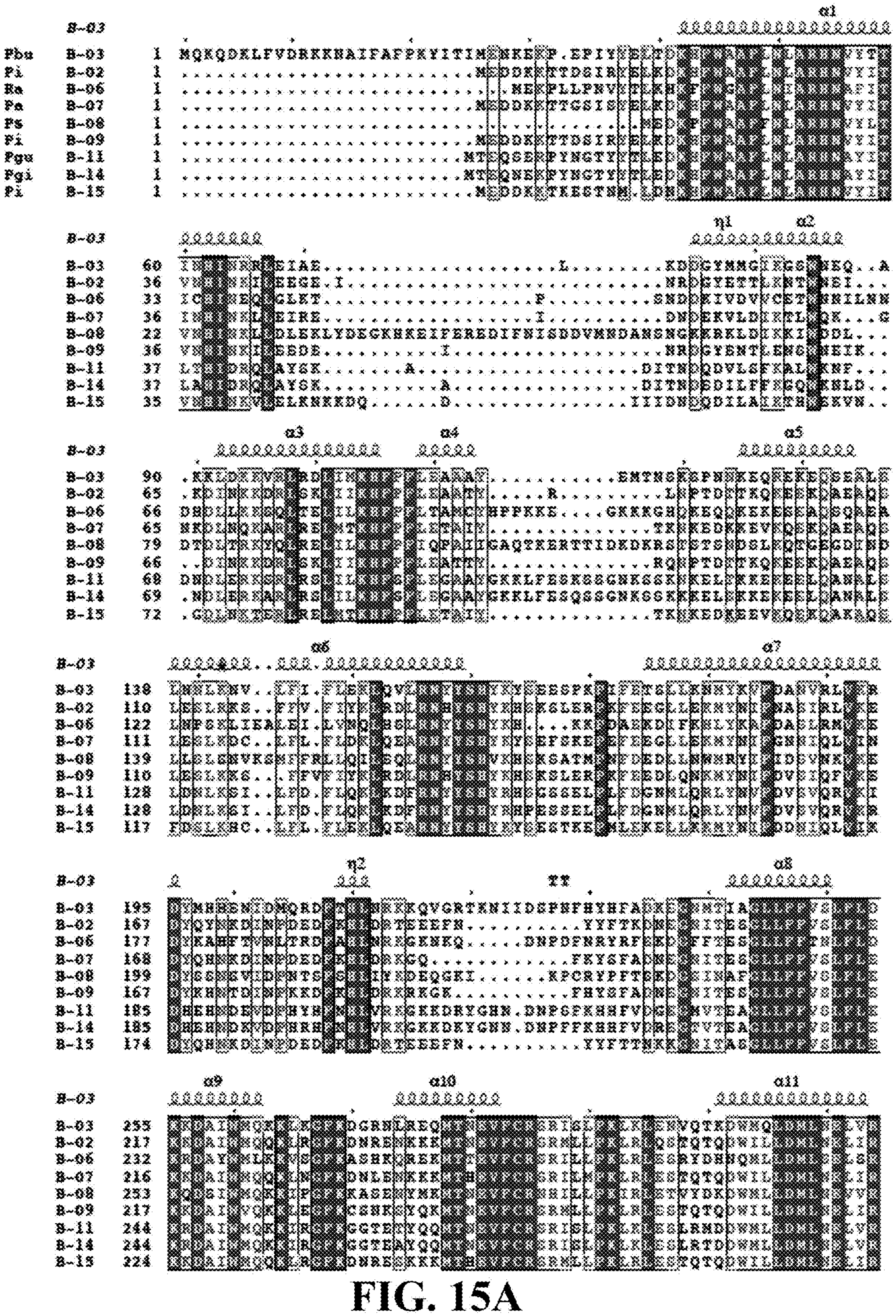
FIG. 15. Structure based alignment of Cas13b subgroup (SEQ ID NOs:14-22).
Figure 15B:
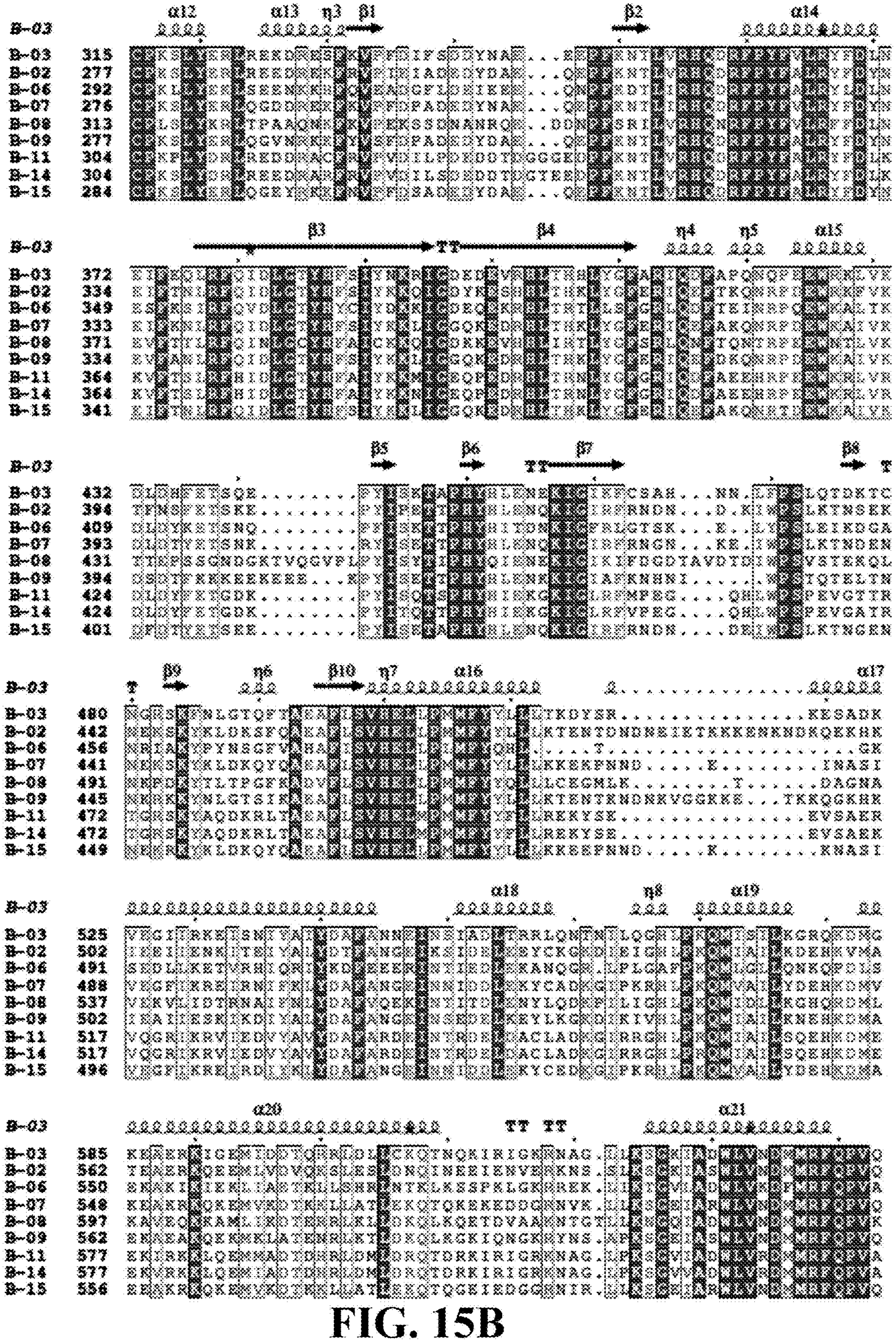
Figure 15C:
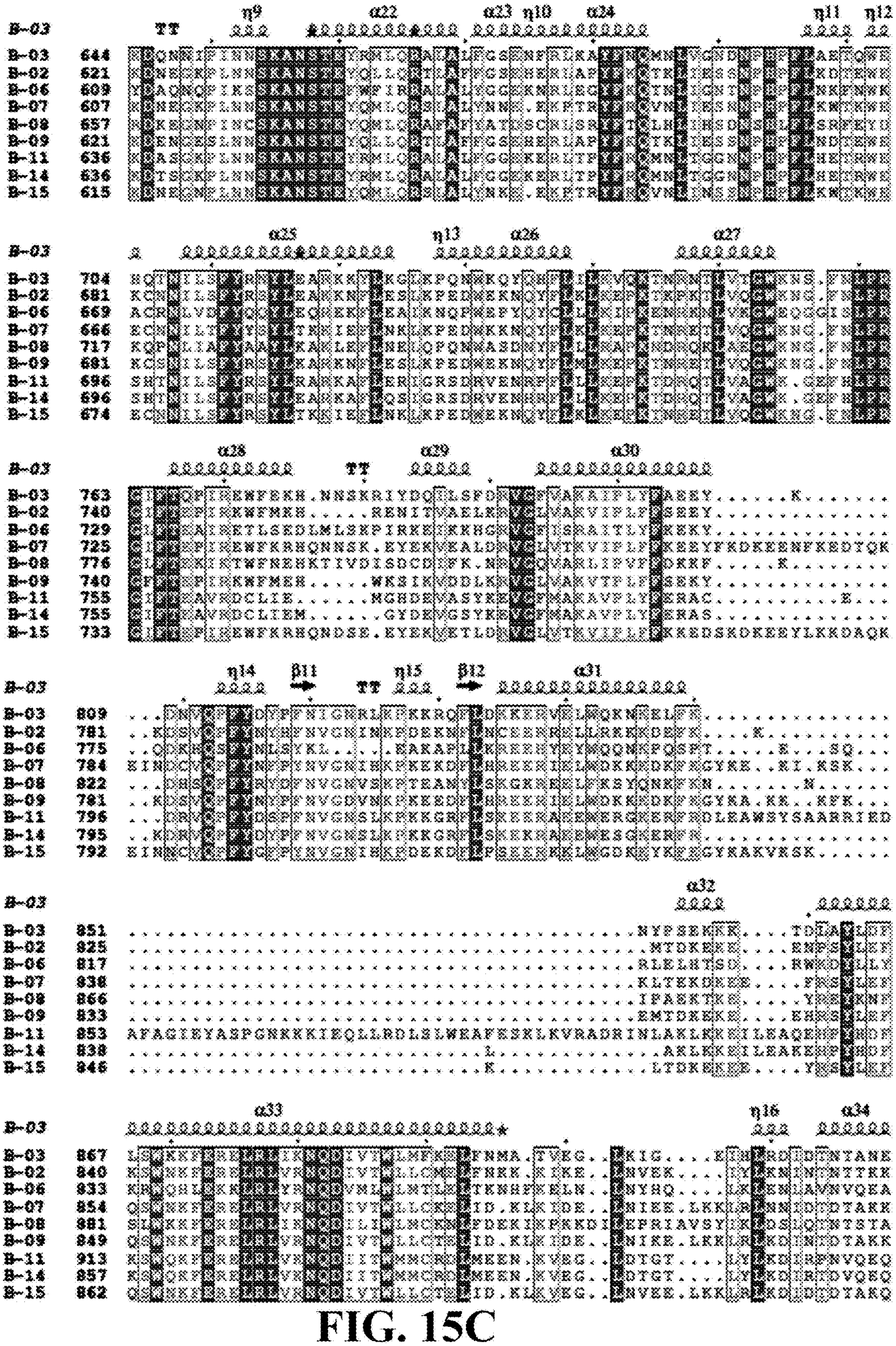
Figure 15D:
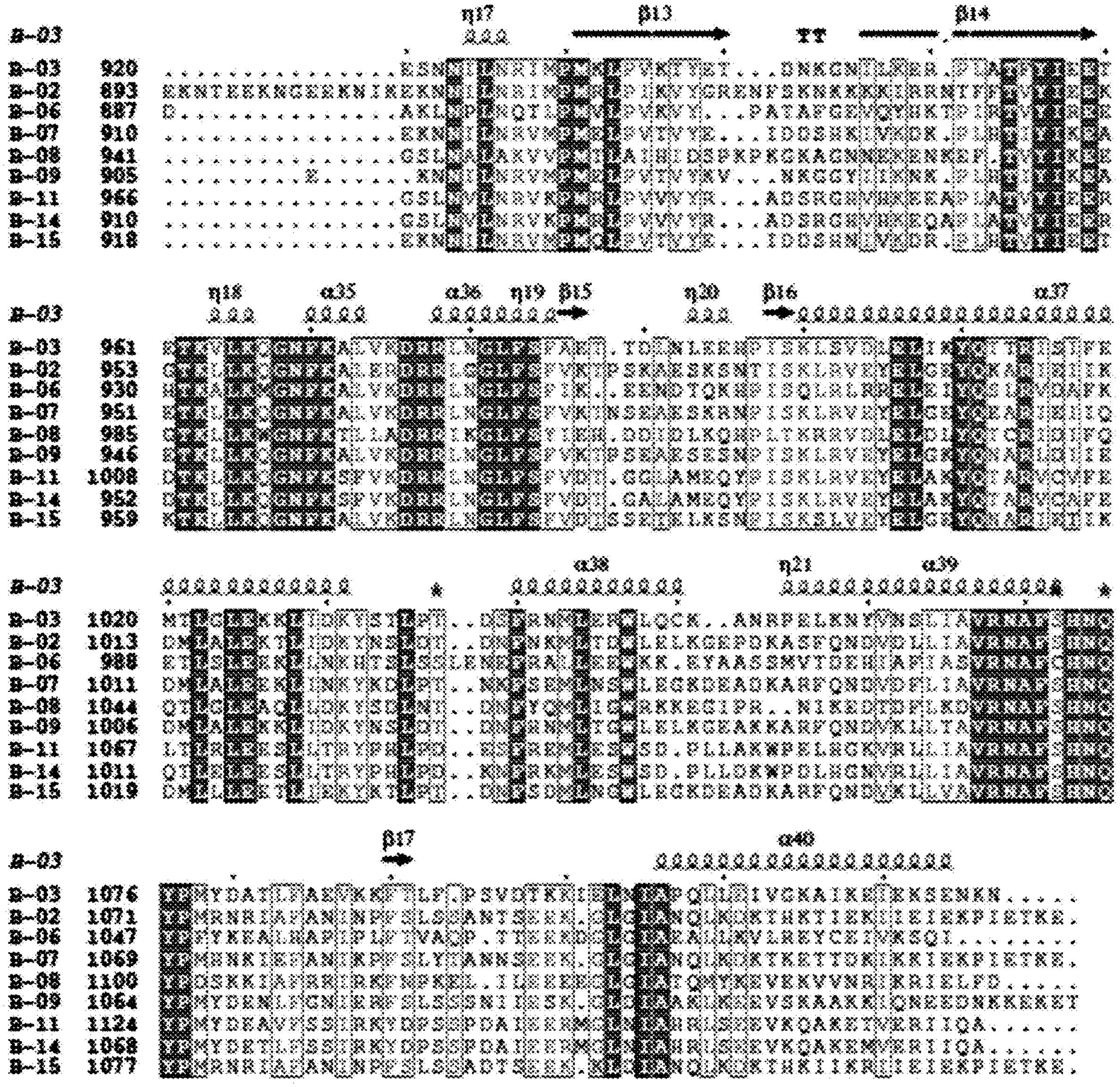
Figure 16A:
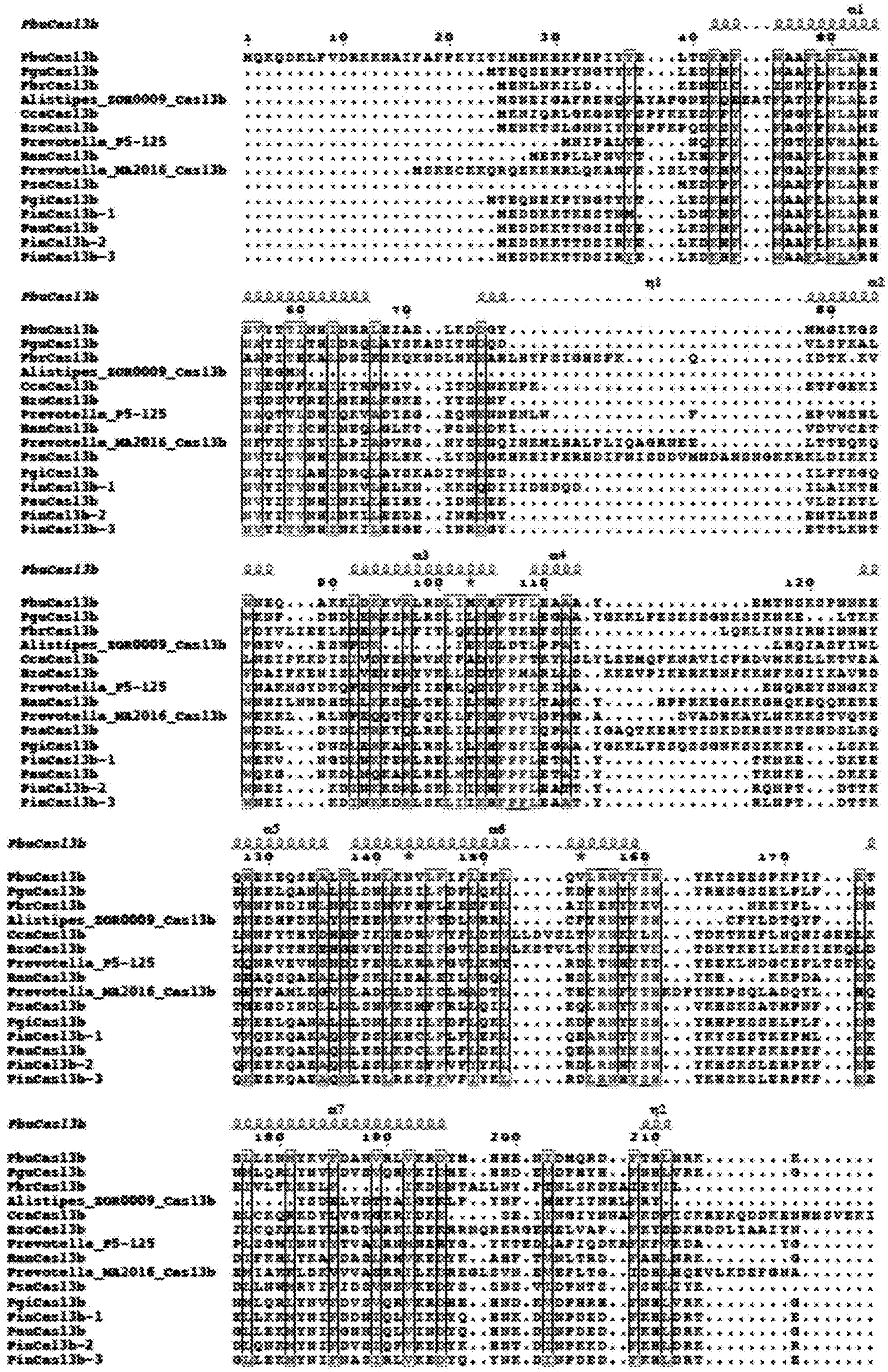
FIG. 16. Structure based alignment of all Cas13bs (SEQ ID NOs:23-37).
Figure 16B:
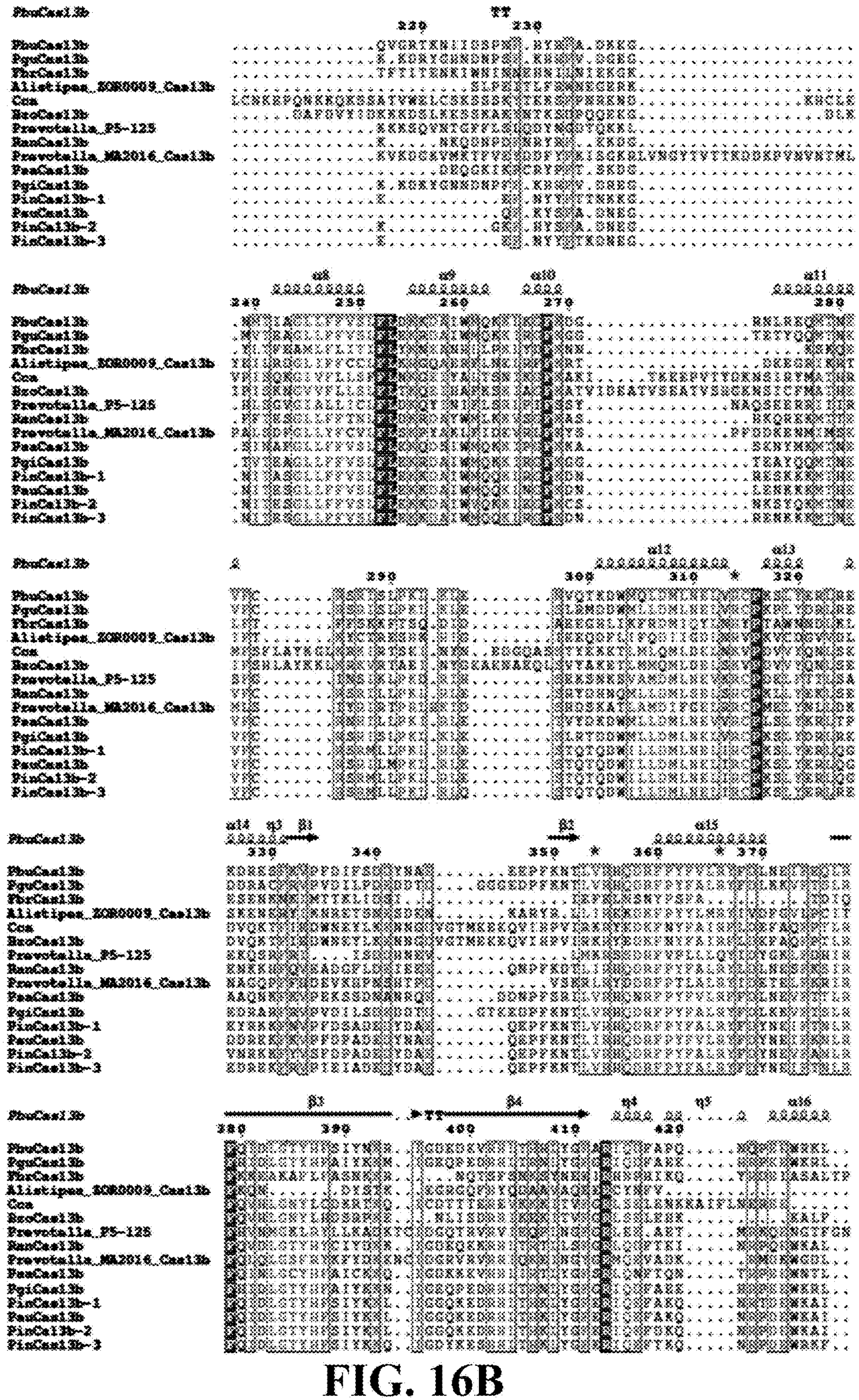
Figure 16C:
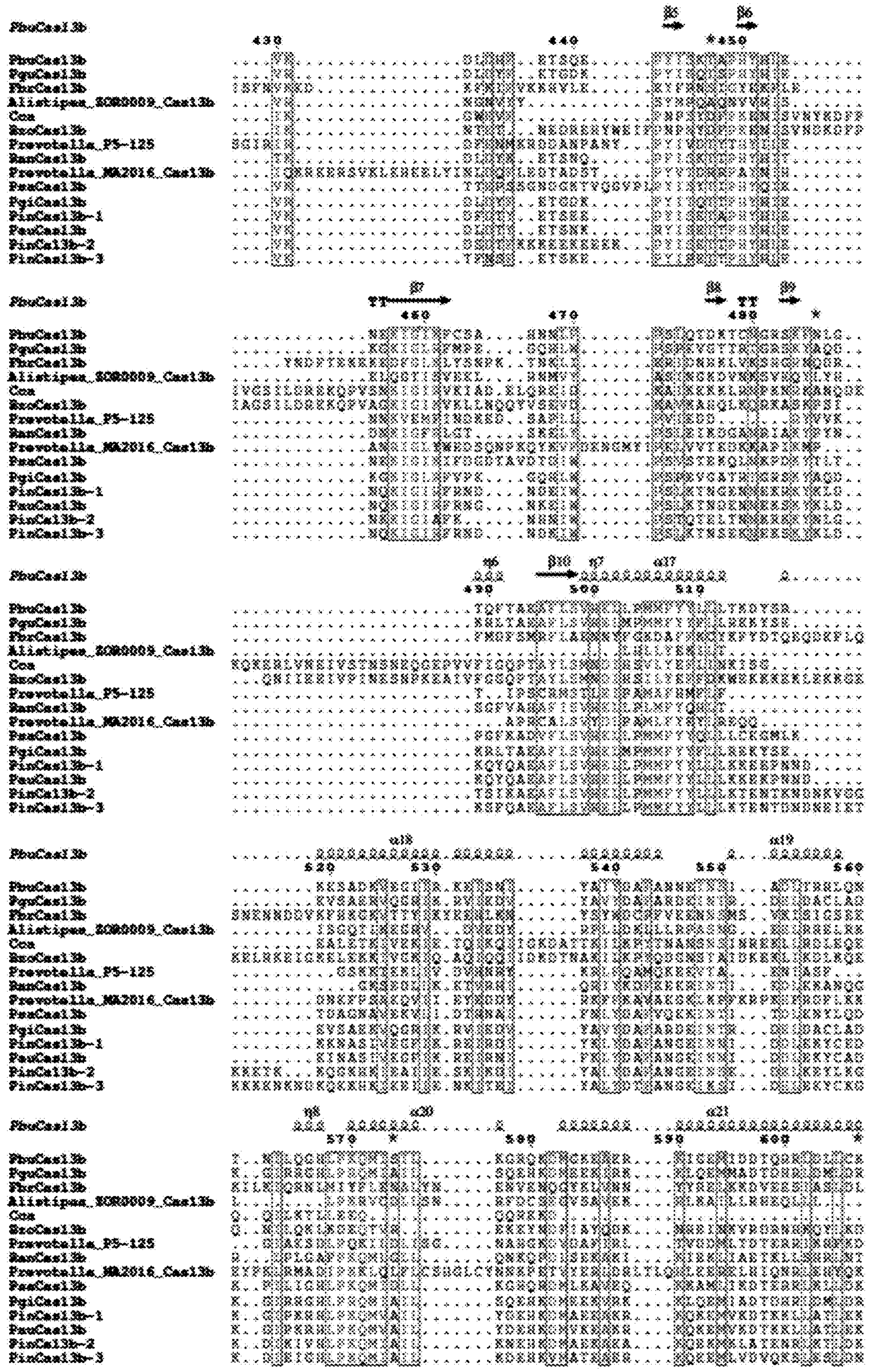
Figure 16D:
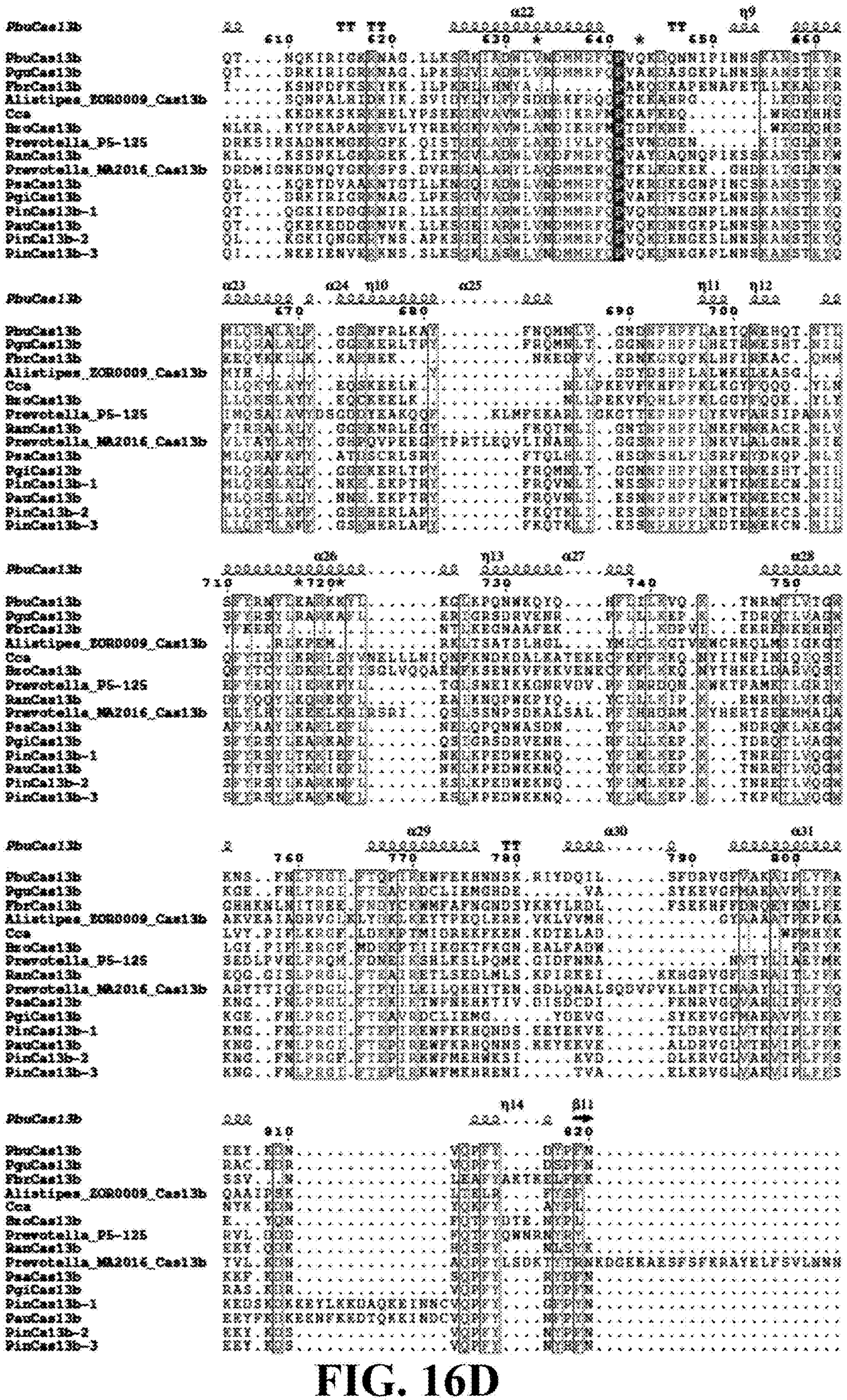
Figure 16E:
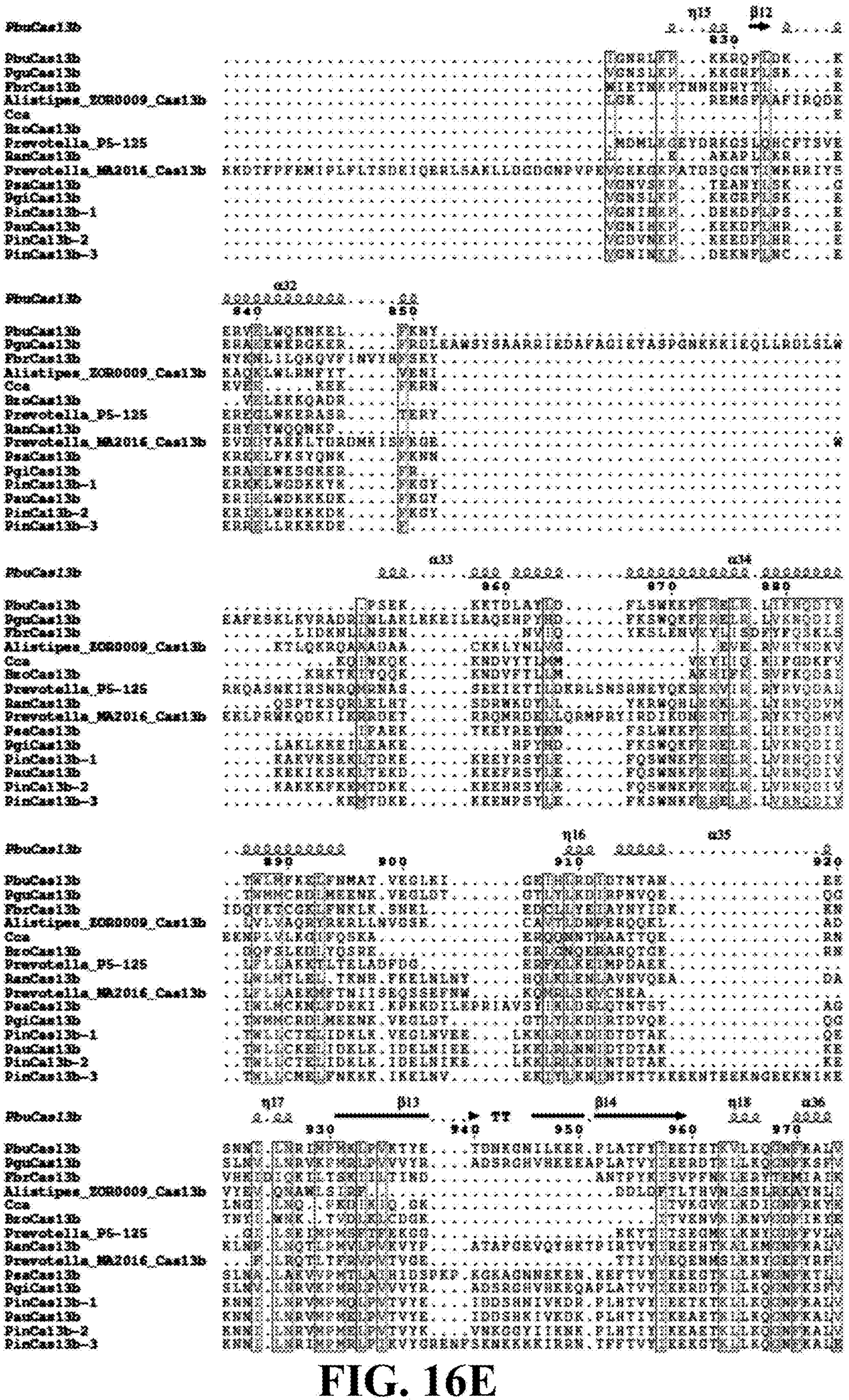
Figure 16F:
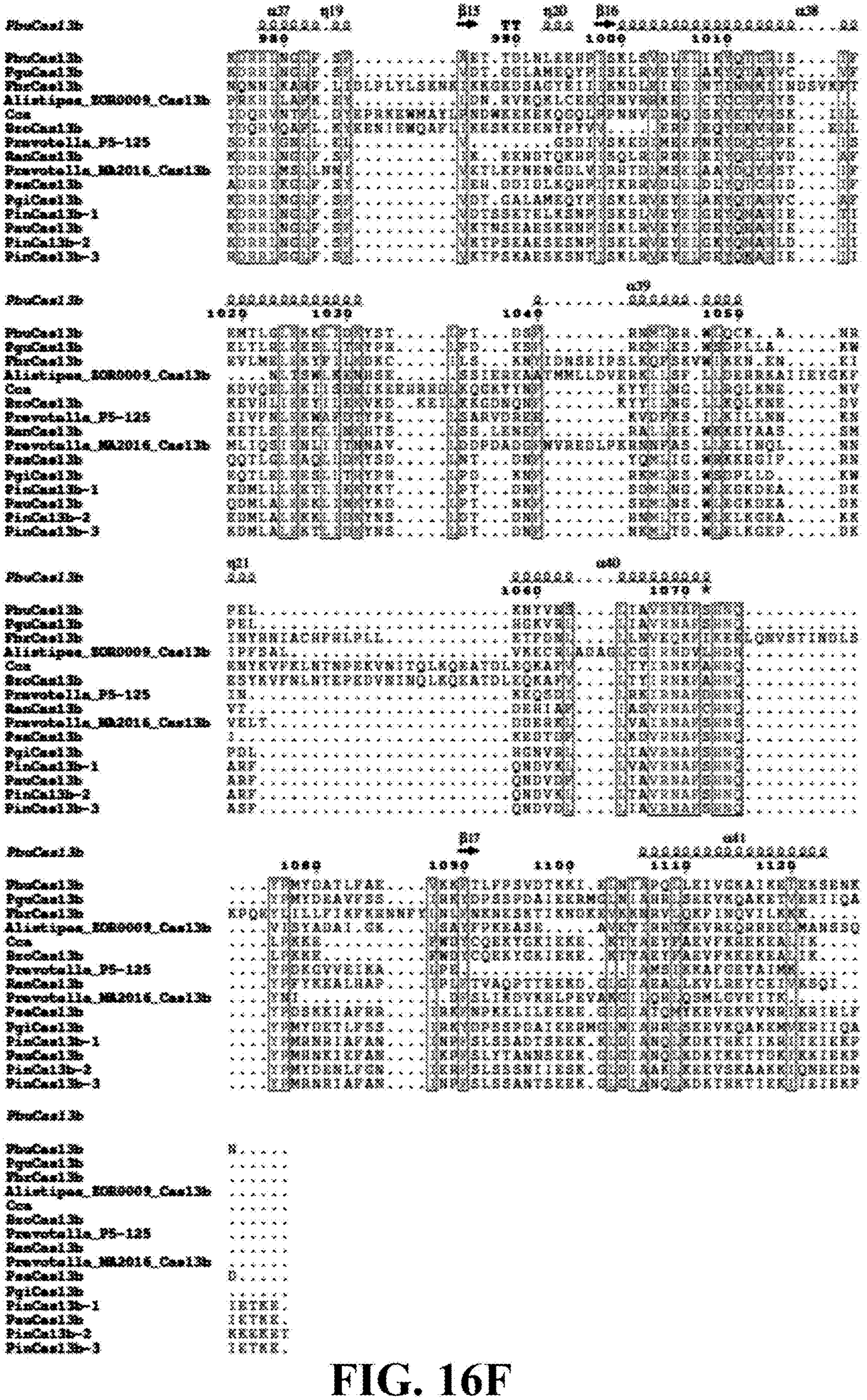
Figure 17A:
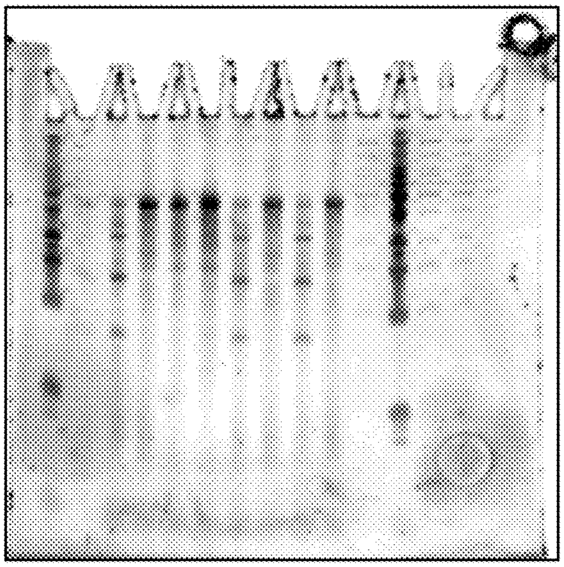
FIGS. 17A-17D. Raw uncropped images of all gels shown in figures.
Figure 17B:
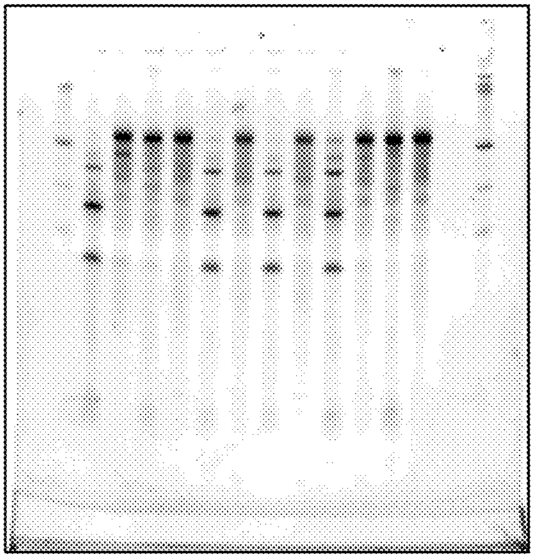
Figure 17C:
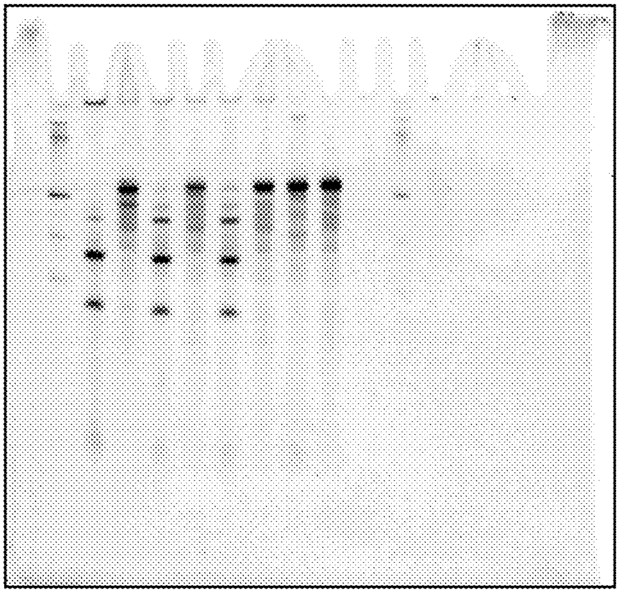
Figure 17D:
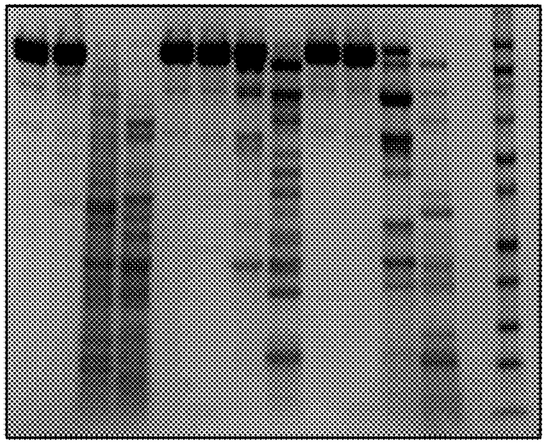

Alignments of Cas13b enzymes were done using ClustalW or Muscle as implemented in Geneious(19). Neighbor-joining trees were generated using a Jukes-Cantor distance model. Conservation alignments for structure analysis were done on a tree subgroup that successfully matched HEPN domain active site residues to other family members (FIGS. 14-16).

Gel Filtration Experiments

Formation of guide complex: 100 μg of PbuCas13b was incubated with two molar equivalents of guide RNA for 20 minutes at room temperature, in 100 μL of buffer (125 mM NaCl, 10 mM HEPES pH 7.0, 2 mM TCEP). Formation of guide-target complex: 100 μg of PbuCas13b and two molar equivalents of guide RNA were incubated together for 20 minutes as above. Two molar equivalents of target RNA were then added to the solution and the mixture was incubated at room temperature for an additional 20 minutes (100 μL total, 125 mM NaCl, 10 mM HEPES pH 7.0, 2 mM TCEP). Apo protein was similarly diluted to 1 μg/μL in a buffer solution of 125 mM NaCl, 10 mM HEPES pH 7.0, 2 mM TCEP. Samples were injected from a 2 mL capillary loop onto an GE Superdex 200 Increase 10/300 GL column and run with 500 mM NaCl, 10 mM HEPES pH 7.0, 2 mM DTT buffer.

ThermoFluor Melting Assay

Protocol was adapted from (20). Samples were prepared to a final volume of 20 μL with 1 μg of PbuCas13b (apo, guide, or guide-target complex, as prepared above) in a solution with a final concentration of 50 mM NaCl, 10 mM HEPES pH 7.0, 6.25×SYPRO™ Orange Dye. For MgCl2 cleavage and binding experiments, a final concentration of 6 mM Mg2+ was added to the buffer mix described. For control experiments with non-complementary RNA, 2 molar equivalents of RNA were incubated with the protein complex. Melting experiments were conducted in triplicate on a Roche LightCycler 480 II.

Limited Proteolysis

10 μg of PbuCas13b was incubated with crRNA or crRNA and target for 30 min at room temperature. 400 μg of protease (Trypsin, Chemotrypsin or Pepsin) was added and the mix was incubated for 5 min at 37 degrees celsius, then placed quickly on ice for 2 min before adding SDS loading buffer and running on a 4-12% acrylamide gel.

Protein Expression and Purification of PbuCas13b Pre-crRNA Processing Mutants

Alanine mutants at each of the putative crRNA-processing catalytic residues were generated using PIPE-site-directed mutagenesis cloning from the TwinStrep-SUMO-PbuCas13b expression plasmid and transformed into BL21

(DE3)pLysE *E coli* cells. For each mutant, 2 L of Terrific Broth media (12 g/L tryptone, 24 g/L yeast extract, 9.4 g/L K2HPO, 2.2 g/L KH2PO4), supplemented with 100 μg/mL ampicilin, was inoculated with 15 mL of overnight starter culture and grown until OD600 0.4-0.6. Protein expression was induced with the addition of 0.5 mM IPTG and carried out for 16 hours at 21° C. with 250 RPM shaking speed. Cells were collected by centrifugation at 5,000 RPM for 10 minutes and paste was directly used for protein purification (10-20 g total cell paste). For Lysis, bacterial paste was resuspended via stirring at 4° C. in 50 mL of lysis buffer (50 mM Tris-HCl pH 7.5, 500 mM NaCl, 1 mM DTT) supplemented with 50 mg Lysozyme, 1 tablet of protease inhibitors (cOmplete, EDTA-free, Roche Diagnostics Corporation) and 500 U of Benzonase (Sigma). The suspension was passed through a LM20 microfluidizer at 25,000 psi and lysate cleared by centrifugation at 10,000 RPM, 4° C. for 1 hour. Lysate was incubated with 2 mL of StrepTactin superflow resin (Qiagen) for 2 hours at 4° C. on a rotary shaker. Resin bound with protein was washed three times with 10 mL of lysis buffer, followed by addition of 50 μL SUMO protease (inhouse) in 20 mL of IGEPAL lysis buffer (0.2% IGEPAL). Cleavage of the SUMO tag and release of native protein was carried out overnight at 4° C. in Econo-column chromatography column under gentle mixing on a table shaker. Cleaved protein was collected as flow-through, washed three times with 5 mL of lysis buffer and checked on a SDS-PAGE gel.

Protein was diluted two-fold with ion exchange buffer A containing no salt (50 mM Tris-HCl pH 7.5, 1 mM DTT) to get the starting NaCl concentration of 250 mM. Protein was then loaded onto a 5 mL Heparin HP column (GE Healthcare Life Sciences) and eluted over a NaCl gradient from 250 mM to 1 M. Fraction of eluted protein (at roughly 700 mM) were analyzed by SDS-PAGE gel and coomassie staining, pooled and concentrated to 1 mL using 50 MWCO centrifugal filters (Amicon). Concentrated protein was loaded onto a pre-equilibrated size exclusion column and eluted using S200 buffer containing 50 mM Tris-HCl pH 7.5, 500 mM NaCl, 2 mM DTT. Monodisperse protein fractions were analyzed by SDS-PAGE gel and coomassie staining, following by concentrating and buffer exchange into protein storage buffer (600 mM NaCl, 50 mM Tris-HCl pH 7.5, 1 mM DTT).

Pre-crRNA Processing Assays

RNA for pre-crRNA processing and nuclease assays were ordered as Ultramers (IDT) and in vitro transcribed using the HiScribe T7 Quick High Yield RNA Synthesis kit (New England Biolabs). RNA was purified with AmpureXP RNA clean up beads and stored at −20° C. for further use. For testing pre-crRNA processing, WT and mutant protein were incubated with pre-crRNA at four times molar excess of protein relative to the RNA. Pre-crRNA processing was carried out in Cas13b crRNA processing buffer (10 mM TrisHCl pH 7.5, 50 mM NaCl, 0.5 mM MgCl2, 20U SUPERase in (ThermoFisher Scientific), 0.1% BSA) for 30 minutes at 37° C., stopped by adding 2×TBE-Urea gel loading buffer and denatured for 5 minutes at 95° C. Samples were immediately put on ice for 10 minutes before running them on an 15% TBE-Urea gel in 1×TBE buffer at 200 V for 40 minutes. Gel staining was carried out in 1×Sybr Gold in 1×TBE for 15 minutes and imaged on a BioRad gel doc system.

Fluorescent Collateral RNA-Cleavage Assay for Pre-crRNA Mutants

Detection assays were carried out as quadruplicates with equimolar ratios of PbuCas13b or PbuCas13b mutants, crRNA and RNA target, in nuclease assay buffer (20 mM HEPES, 60 mM NaCl, 6 mM MgCl2, pH 6.8) with 0.5 μL murine RNase inhibitor (New England Biolabs) and 125 nM of poly-U homopolymer RNA sensor (Trilink). Samples were incubated for 3 hours at 37° C. on a fluorescent plate reader equipped with a FAM filter set. Measurements were recorded at 5-minute intervals and data normalized to the first time-point.

Cleavage Fragment Library

To map Cas13 cleavage products, in vitro cleavage reactions were performed as described above with LwCas13a and PbuCas13b, their respective crRNAs and target RNA or control. Cleavage was carried out for 5 or 30 minutes and purified using an RNA oligo clean and concentrator kit (Zymo research). Small RNA sequencing libraries were prepared according to the NEB Multiplex Small RNA sequencing kit sequenced on an Illumina NextSeq 500 instrument.

Design and Cloning of Mammalian Constructs for RNA Editing

PguCas13b was made catalytically inactive (dPguCas13b) by mutating two arginine and two histidine residues in the catalytic sites of the HEPN domains to alanines (R146A/H151A/R1116A/H1121A). These catalytically inactivated Cas13bs were Gibson cloned into pcDNA-CMV vector backbones containing the deaminase domain of ADAR2 (E488Q) fused to the C terminal end of the Cas13b via a GS linker (21). To generate truncated versions, primers were designed to PCR amplify the dCas13b that truncated off 60 bp (20 amino acids) progressively up to 900 bp off of the C terminal end (15 truncations in total), and these truncated Cas13b genes were Gibson cloned into the pcDNA-CMV-ADAR2 backbone described above. Guide RNAs targeting Cluc were cloned using golden gate cloning into a mammalian expression vector containing the direct repeat sequence for this ortholog at the 3' end of the spacer sequence destination site, under the U6 promoter.

The luciferase reporter used was a CMV-Cluc (W85X) EF1alpha-Gluc dual luciferase reporter used by Cox et. al. (2017) to measure RNA editing (21). This reporter vector expresses functional Gluc as a normalization control, but a defective Cluc due to the addition of the W85X pretermination site.

Mammalian Cell Culture

Mammalian cell culture experiments were performed in the HEK293FT line (American Type Culture Collection (ATCC)), which was grown in Dulbecco's Modified Eagle Medium with high glucose, sodium pyruvate, and GlutaMAX (Thermo Fisher Scientific), additionally supplemented with 1×penicillin-streptomycin (Thermo Fisher Scientific) and 10% fetal bovine serum (VWR Seradigm).

All transfections were performed with Lipofectamine 2000 (Thermo Fisher Scientific) in 96-well plates. Cells were plated at approximately 20,000 cells/well 16-18 hours prior to transfection to ensure 90% confluency at the time of transfection. For each well on the plate, transfection plasmids were combined with Opti-MEM I Reduced Serum Medium (Thermo Fisher) to a total of 25 μl. Separately, 24.5 μl of Opti-MEM was combined with 0.5 μl of Lipofectamine 2000. Plasmid and Lipofectamine solutions were then mixed and pipetted onto cells.

RNA Knockdown in Mammalian Cells

To assess RNA targeting in mammalian cells with reporter constructs, 150 ng of Cas13 construct was co-transfected with 300 ng of guide expression plasmid and 45 ng of the dual luciferase reporter construct. 48 hours post-transfection, media containing secreted luciferase was harvested, and measured for activity with BioLux Cypridinia and Biolux *Gaussia* luciferase assay kits (New England Biolabs) on a plate reader (Biotek Synergy H4) with an injection protocol. Signal from the targeted Gluc was normalized to signal from un-targeted Cluc, and subsequently, experiments with PbCas13b mutant luciferase signal were normalized to experiments with guide-only luciferase signal (the average of three bioreplicates). All replicates performed are biological replicates.

REPAIR Editing in Mammalian Cells

To assess REPAIR activity in mammalian cells, Applicants transfected 150 ng of REPAIR vector, 300 ng of guide expression plasmid, and 45 ng of the RNA editing reporter. Applicants then harvested media with the secreted luciferase after 48 hours and diluted the media 1:10 in Dulbecco's phosphate buffered saline (PBS) (10 μl of media into 90 μl PBS). Applicants measured luciferase activity with BioLux Cypridinia and Biolux *Gaussia* luciferase assay kits (New England Biolabs) on a plate reader (Biotek Synergy Neo2) with an injection protocol. All replicates performed are biological replicates.

REFERENCES

1. W. Kabsch, Integration, scaling, space-group assignment and post-refinement. Acta Crystallogr D Biol Crystallogr 66, 133-144 (2010).
2. W. Kabsch, Xds. Acta Crystallogr D Biol Crystallogr 66, 125-132 (2010).
3. P. R. Evans, G. N. Murshudov, How good are my data and what is the resolution? Acta Crystallogr D Biol Crystallogr 69, 1204-1214 (2013).
4. C. Vonrhein et al., Data processing and analysis with the autoPROC toolbox. Acta Crystallogr D Biol Crystallogr 67, 293-302 (2011).
5. P. D. Adams et al., PHENIX: a comprehensive Python-based system for macromolecular structure solution. Acta Crystallogr D Biol Crystallogr 66, 213-221 (2010).
6. T. C. Terwilliger et al., Decision-making in structure solution using Bayesian estimates of map quality: the PHENIX AutoSol wizard. Acta Crystallogr D Biol Crystallogr 65, 582-601 (2009).
7. T. C. Terwilliger et al., Iterative model building, structure refinement and density modification with the PHENIX AutoBuild wizard. Acta Crystallogr D Biol Crystallogr 64, 61-69 (2008).
8. P. Emsley, B. Lohkamp, W. G. Scott, K. Cowtan, Features and development of Coot. Acta Crystallogr D Biol Crystallogr 66, 486-501 (2010).
9. P. Emsley, K. Cowtan, Coot: model-building tools for molecular graphics. Acta Crystallogr D Biol Crystallogr 60, 2126-2132 (2004).
10. P. V. Afonine et al., Towards automated crystallographic structure refinement with phenix.refine. Acta Crystallogr D Biol Crystallogr 68, 352-367 (2012).
11. N. Echols et al., Automated identification of elemental ions in macromolecular crystal structures. Acta Crystallogr D Biol Crystallogr 70, 1104-1114 (2014).
12. P. H. Zwart et al., Automated structure solution with the PHENIX suite. Methods Mol Biol 426, 419-435 (2008).
13. N. W. Moriarty, R. W. Grosse-Kunstleve, P. D. Adams, electronic Ligand Builder and Optimization Workbench (eLBOW): a tool for ligand coordinate and restraint generation. Acta Crystallogr D Biol Crystallogr 65, 1074-1080 (2009).
14. The PyMOL Molecular Graphics System, Version 2.0 Schrödinger, LLC.
15. X. J. Lu, H. J. Bussemaker, W. K. Olson, DSSR: an integrated software tool for dissecting the spatial structure of RNA. Nucleic Acids Res 43, e142 (2015).
16. H. Ashkenazy et al., ConSurf 2016: an improved methodology to estimate and visualize evolutionary conservation in macromolecules. Nucleic Acids Res 44, W344-350 (2016).
17. T. A. de Beer, K. Berka, J. M. Thornton, R. A. Laskowski, PDBsum additions. Nucleic Acids Res 42, D292-296 (2014).
18. E. Jurrus et al., Improvements to the APBS biomolecular solvation software suite. Protein Sci 27, 112-128 (2018).
19. L. A. Ripma, M. G. Simpson, K. Hasenstab-Lehman, Geneious! Simplified genome skimming methods for phylogenetic systematic studies: A case study in Oreocarya (Boraginaceae). Appl Plant Sci 2, (2014).
20. K. Huynh, C. L. Partch, Analysis of protein stability and ligand interactions by thermal shift assay. Curr Protoc Protein Sci 79, 28 29 21-14 (2015).
21. D. B. T. Cox et al., RNA editing with CRISPR-Cas13. Science 358, 1019-1027 (2017).

Results

Type VI CRISPR-Cas systems contain programmable single-effector RNA-guided RNases, including Cas13b, one of the four known type VI subtype family members. Cas13b is unique among these protein families in its linear domain architecture and CRISPR RNA (crRNA) structure. Applicants report the crystal structure of *Prevotella buccae* Cas13b (PbuCas13b) bound to crRNA at 1.97 angstrom resolution. The structure reveals that the guide RNA was coordinated within Cas13b by a network of direct and indirect interactions that mediated nuclease activity. Applicants identified a second active site for crRNA processing and show that mutation of key residues in this site abrogates processing activity. Applicants also found the HEPN2 nuclease domain was non-essential for RNA targeting and established a basis for structure-guided engineering of RNA targeting with Cas13b.

Here Applicants report the structure of Cas13b from *Prevotella buccae* (PbuCas13b) in complex with a crRNA handle and partial spacer at 1.97 angstrom resolution. Our structure revealed the overall architecture of Cas13b nucleases and the molecular basis for crRNA recognition and cleavage.

Figure 18:
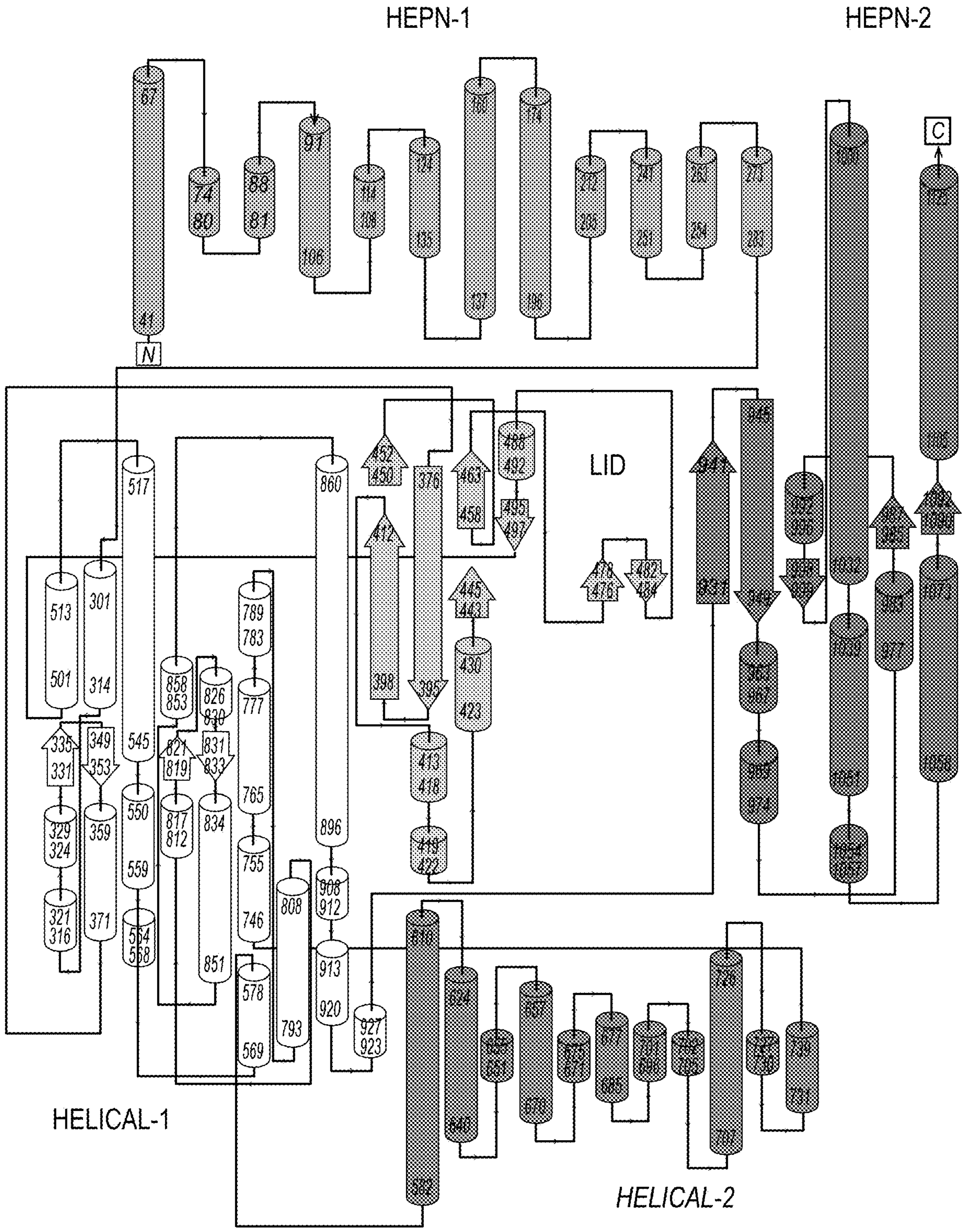
FIG. 18. Grouped topology map of PbuCas13b crystal structure.

Applicants solved the crystal structure of PbuCas13b complexed with a 36-nucleotide direct repeat sequence and a short 5-nucleotide spacer (FIG. 1). Similar to other Class 2 CRISPR effectors, the overall shape of PbuCas13b is bilobed (13-19). Five domains are apparent within the structure: two HEPN domains (HEPN1 and HEPN2), two predominantly helical domains (Helical-1 and Helical-2), and a domain that caps the 3' end of the crRNA with two beta hairpins (Lid domain) (FIG. 1, FIG. 18). To identify similarities to other domains in the protein data bank, the complete PbuCas13b structure as well as isolated domains were queried using the DALI server (15). HEPN1 matched to the HEPN2 domain of LshCas13a.

Figure 5A:
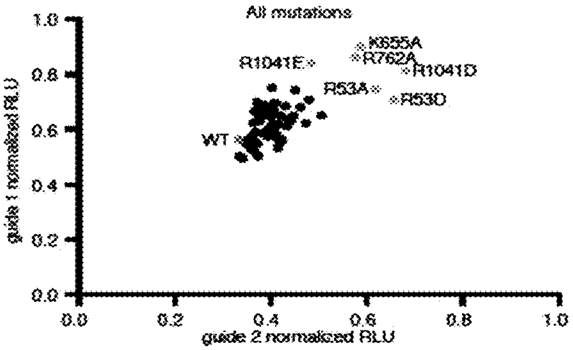
FIGS. 5A-5H. Site-directed mutagenesis of PbuCas13b; RNA interference in mammalian cell.
Figure 5B:
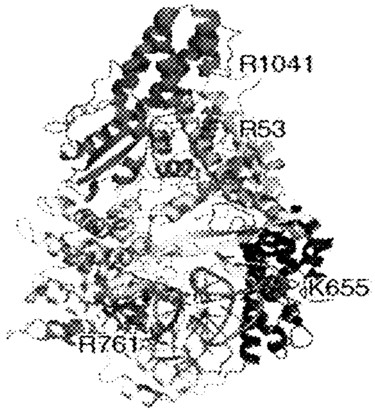
Figure 5C:
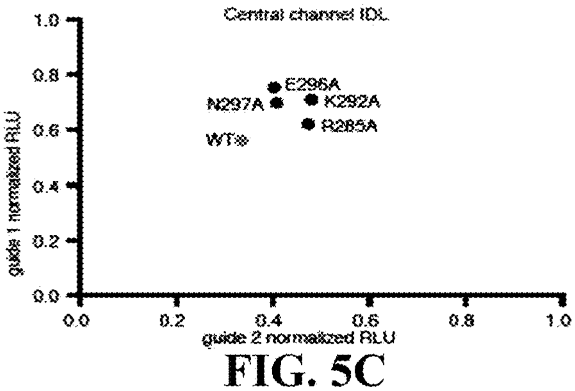

Both HEPN domains were largely alpha helical: HEPN1 was made of twelve linearly connected α-helices with flexible loops in between the helices. HEPN2 was composed of nine α-helices, several short β-strands, and a β-hairpin with charged residues at the tip, which pointed towards the active site pocket. HEPN2 rested on HEPN1 such that the active site residues (R156, N157, H161 and R1068, N1069, H1073) were assembled into a canonical HEPN active site, despite being at the N- and C-terminal extremities of the linear protein (FIG. 1) (3, 17, 18, 20). The HEPN1 domain was connected to the Helical-1 domain by a highly conserved inter-domain linker (IDL) that reached across the center of a large, positively charged inner channel (FIG. 1). Mutation of conserved residues of the IDL (R285, K292, E296) to alanine reduces the ability of PbuCas13b to interfere with luciferase expression in mammalian cells by cleaving luciferase mRNA, demonstrating a role in general nuclease activity (FIGS. 5A,C).

Figure 1A:
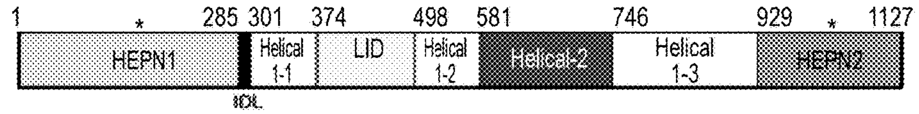
FIGS. 1A-1D. The crystal structure of PbuCas13b-crRNA Binary Complex.
Figure 1B:
Figure 1C:
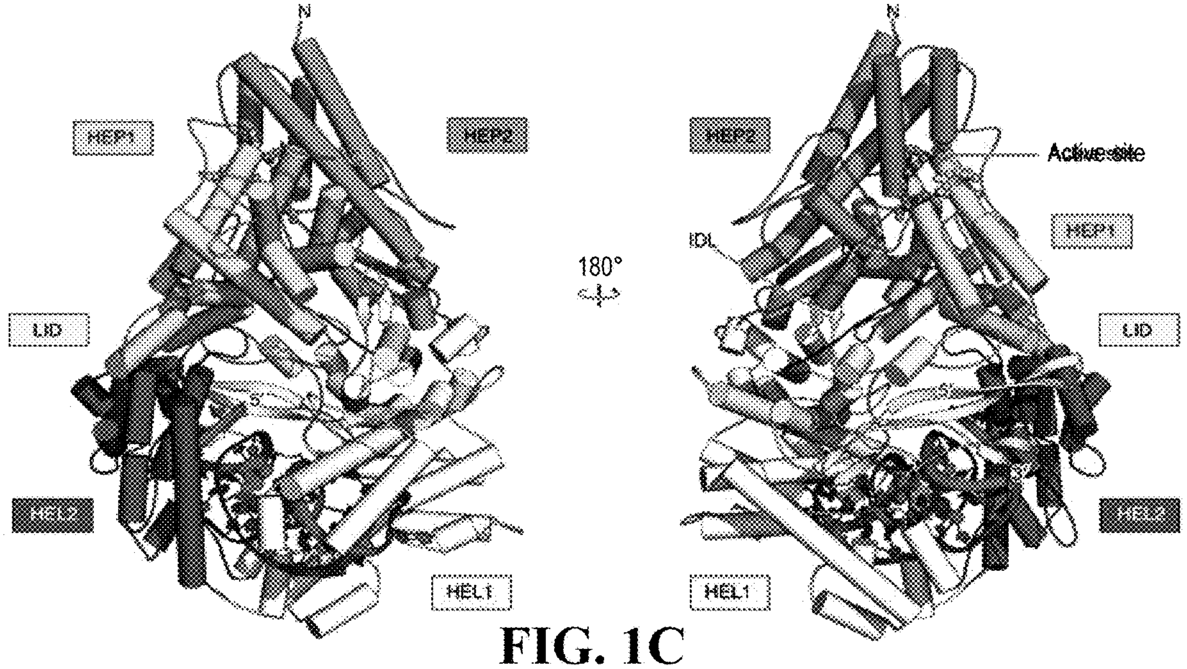
Figure 1D:
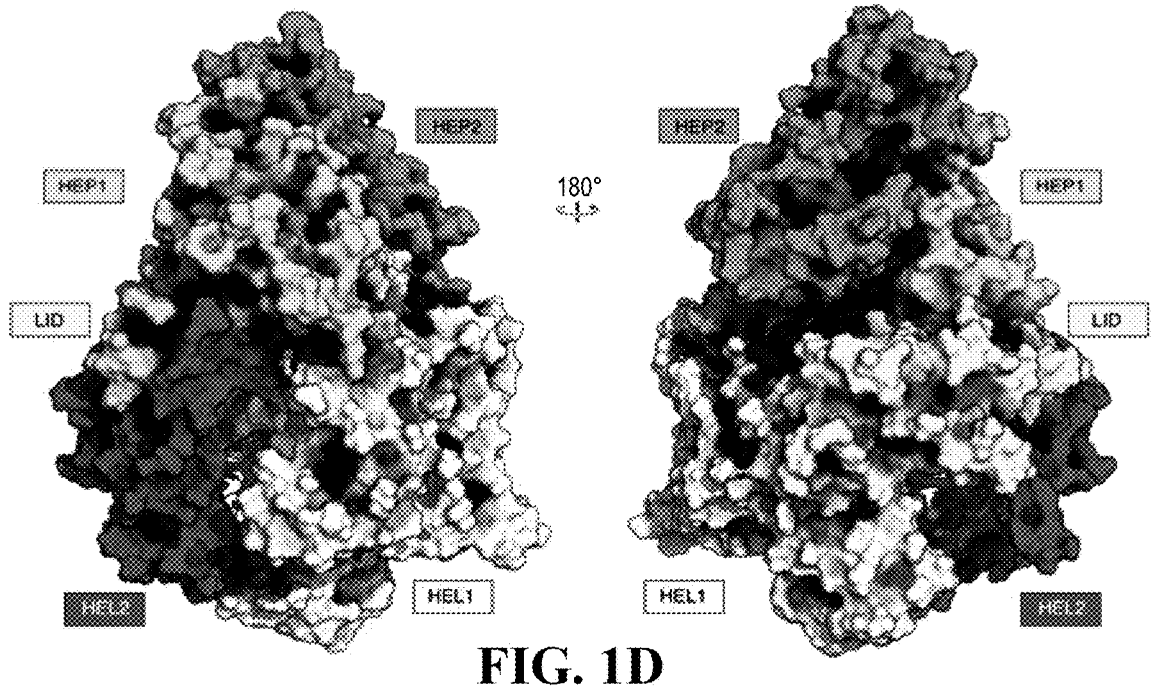
Figure 2A:
FIGS. 2A-2E. PbuCas13b crRNA recognition.
Figure 2B:
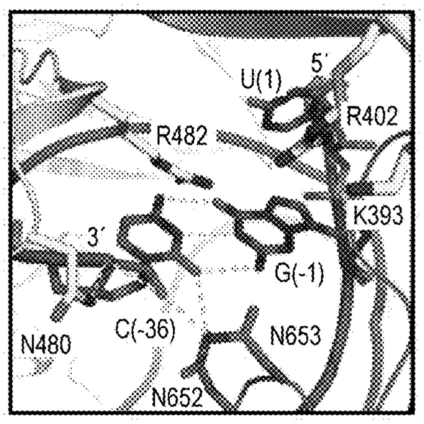
Figure 2C:
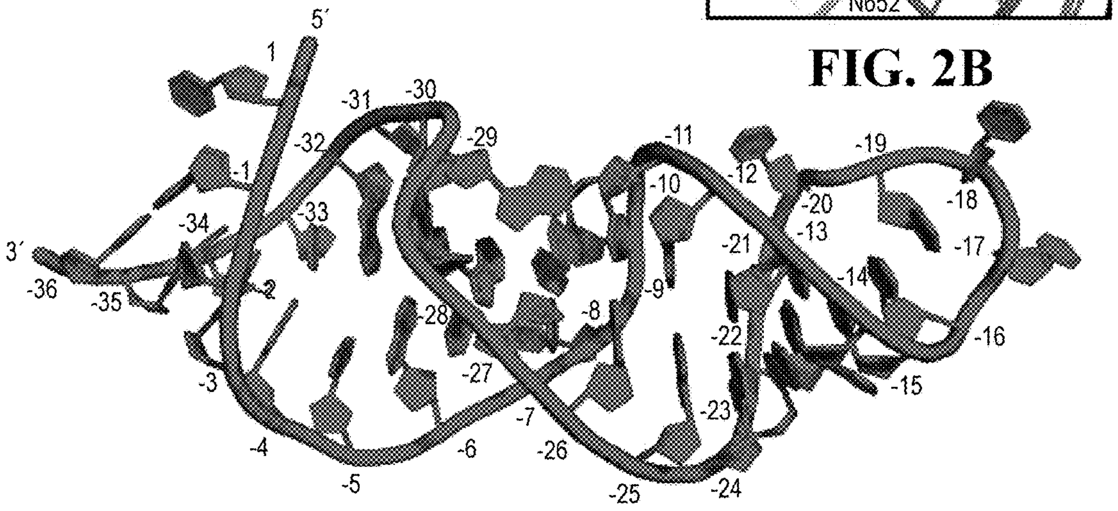
Figure 2D:
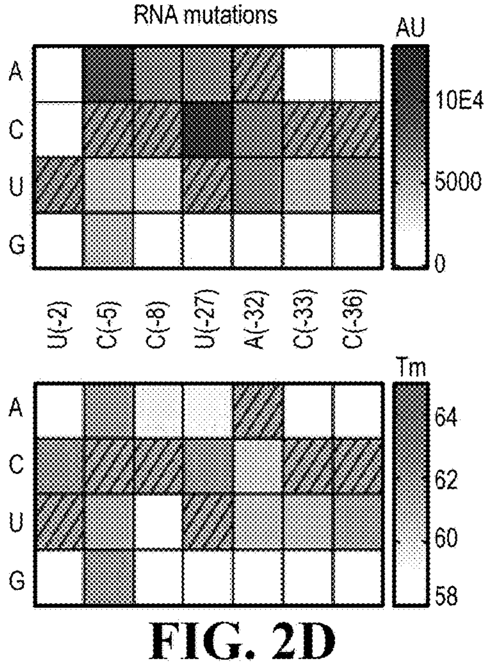
Figure 2E:
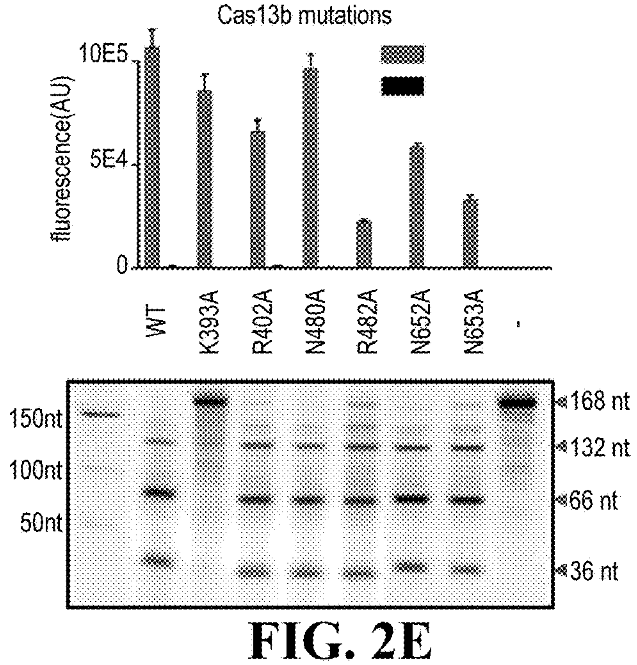
Figure 3:
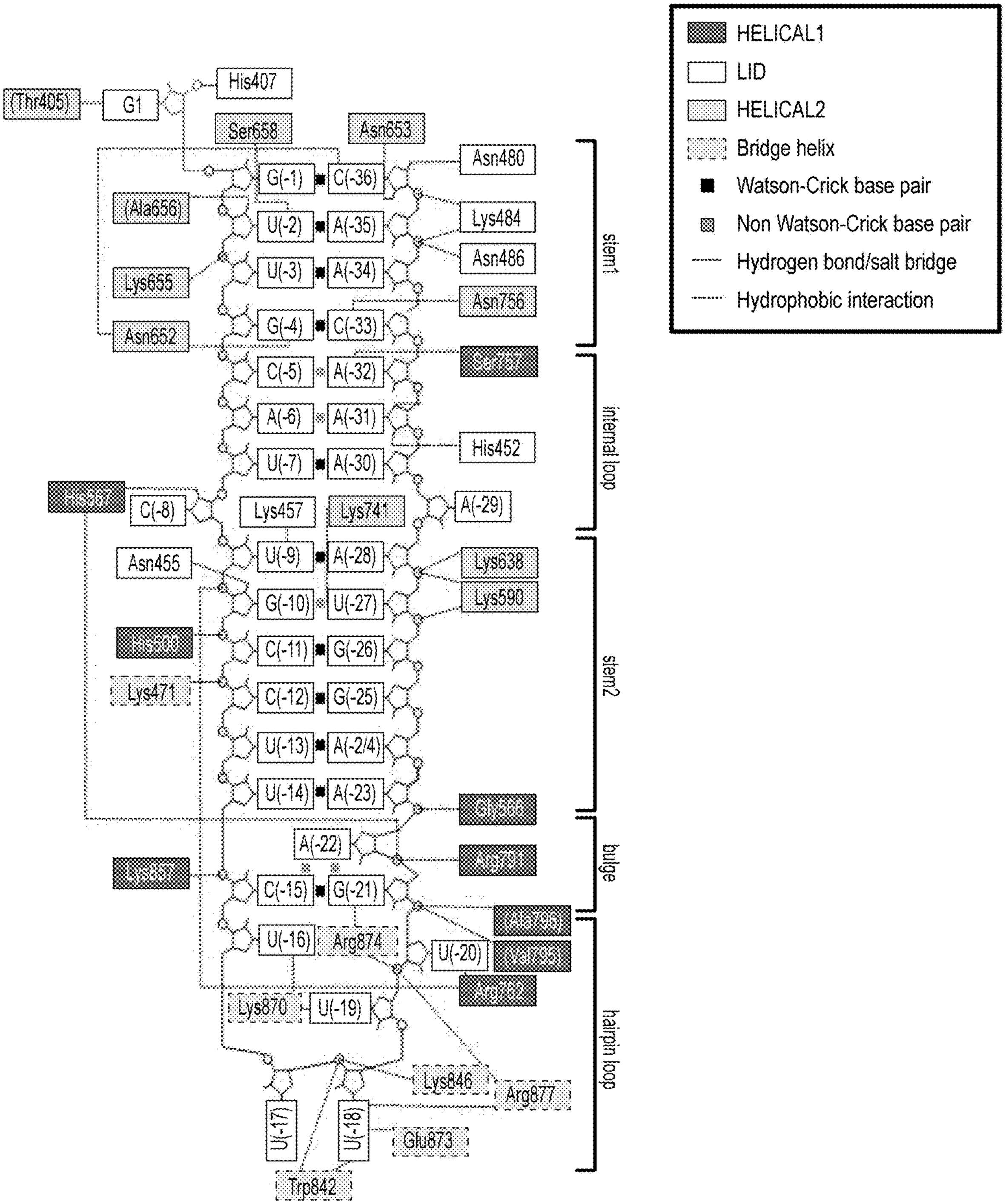
FIG. 3. Schematic view of the intermolecular contacts between PbuCas13b and crRNA (SEQ ID NO:2).
Figure 6A:
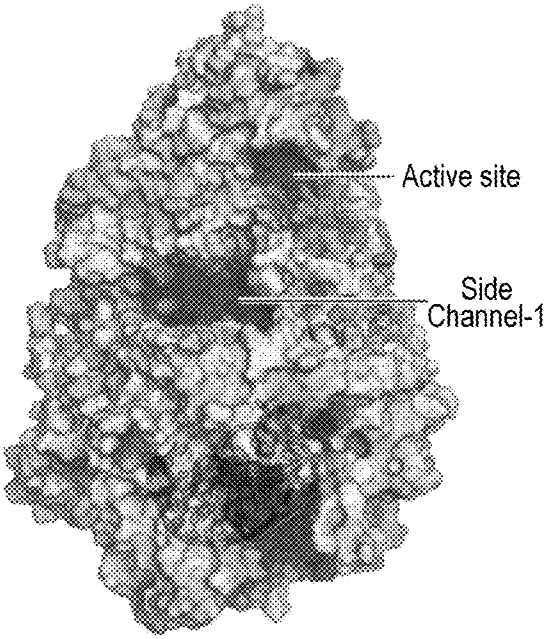
FIGS. 6A-6D.
Figure 6B:
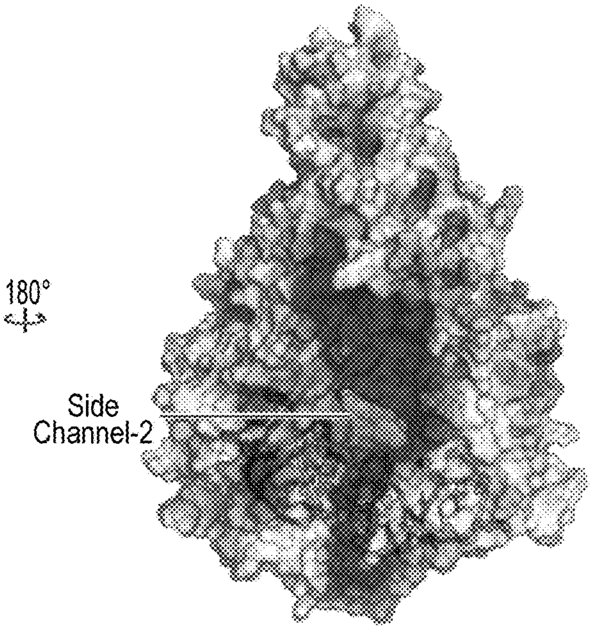
Figure 6C:
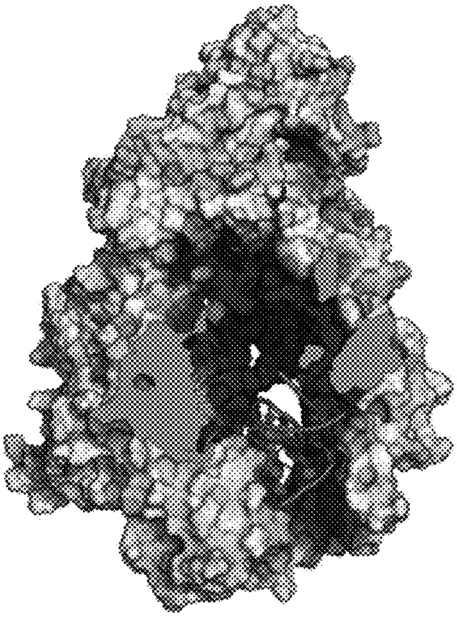
Figure 6D:
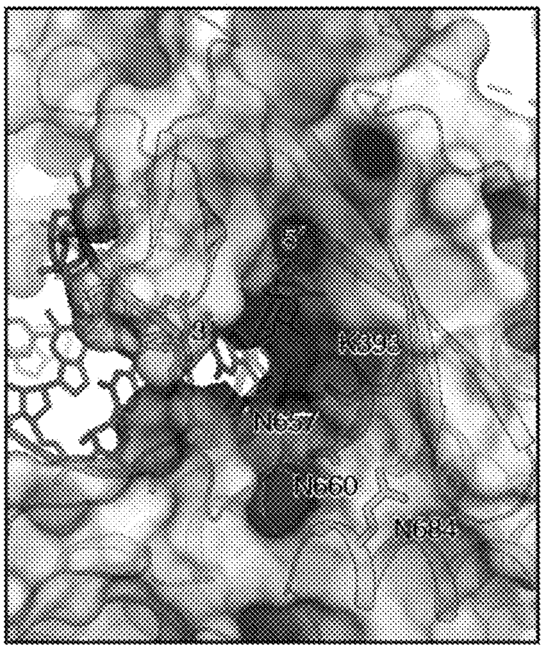

Helical-1 was broken up linearly into three segments by the Helical-2 and Lid domains. Helical-1 made extensive sugar-phosphate and nucleobase contacted with the direct repeat RNA (FIG. 2, FIG. 3). Helical-1 also made minor interface contacts with both HEPN1/2 and the Lid domains. The Lid domain was mixed a and R secondary structure and caps the 3' free end of the direct repeat RNA with two charged β-hairpins. The longer of the two 0-hairpins reached across the RNA loop to contact the Helical-1 domain, forming a lid over the free RNA ends. Positively charged residues from the Lid domain pointed into a large central channel running through the center of the protein complex (FIG. 1, FIG. 6C). A positively charged side channel penetrating from the outer solvent to the inner channel was formed between a disordered loop (K431 to T438) of the Lid domain and the two HEPN domains (FIG. 6A). The Helical-2 domain was made of eleven α-helices and wrapped under the body of the direct repeat RNA via its connection to Helical-1. Helical-2 interfaced extensively with the HEPN1 domain and made minor contacts with the extended β-hairpin of the Lid domain. A second positively charged side channel was between Helical-1 and Helical-2, providing bulk solvent accessibility to the crRNA (FIG. 6B). All domains, the IDL, and the crRNA formed the large central channel, the inside of which was lined with positively charged residues (FIG. 6C).

Figure 7:
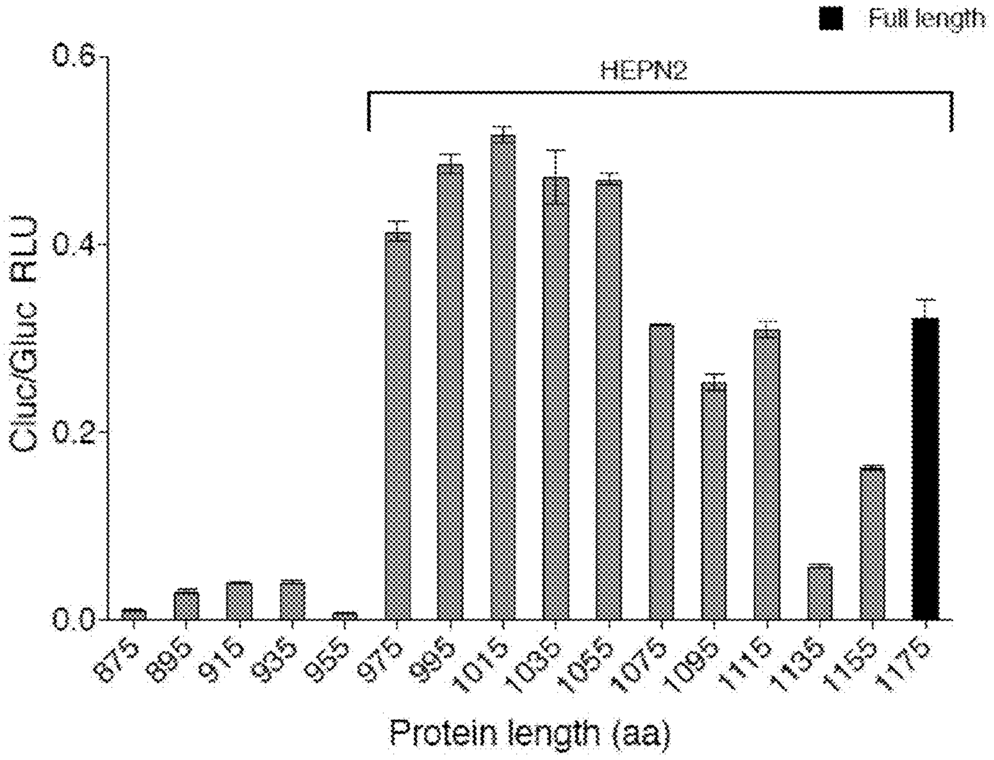
FIG. 7. REPAIR assay of pgCas13b C-terminal truncations.

Nuclease-dead Cas13b fused to an ADAR deaminase domain was used for REPAIR to achieve targeted RNA base editing (11). AAV-mediated delivery is commonly used for gene therapies, but REPAIR exceeds the size limit of AAV's cargo capacity (11, 21). Applicants showed previously that C-terminal truncations of *Prevotella* sp. P5-125 (PspCas13b) did not decrease REPAIR activity. Applicants further used another ortholog of Cas13b, from *Porphyromonas* gulae (PguCas13b), which was stably expressed and showed high activity in mammalian cells, in contrast to PbuCas13b (11). Based on alignments between PbuCas13b and PguCas13b, Applicants made truncations to remove the HEPN2 domain, fused it to ADAR, and tested its ability to carry out base editing with the REPAIR system. Surprisingly, not only did these truncated mutants retain RNA targeting, some were significantly more efficient at RNA editing (FIG. 7).

Cas13b has been shown to function efficiently in REPAIR with crRNAs of various lengths, with spacers ranging from 30 to 84 nucleotides (11). Unambiguous density for all RNA bases enabled complete model building of the direct repeat RNA. The structure revealed Cas13b recognized the direct repeat by extensive sugar-phosphate and nucleobase interactions (FIGS. 2 and 3). The direct repeat was mostly buried between the two Helical domains and the Lid domain but protruded slightly from Helical-1, explaining how Cas13b was able to utilize an alternate, longer crRNA. The overall crRNA structure was a deformed A-form duplex comprising a stem (bases G(−1)-G(−4), C(−33)-C(−36)), loop (C(−5)-U(−8), A(−29)-A(−32)), stem (U(−9)-U(−14), A(−23)-A(−28)), bulge (C(−15), G(−21)), and hairpin loop (U(−16)-U(−20)) architecture (FIGS. 2 and 3). Helical-1 and Helical-2 mediated direct and indirect recognition of the crRNA hairpin together with the Lid domain, which capsped the 3' free end.

Figure 8A:
FIGS. 8A-8G.
Figure 8B:
Figure 8C:
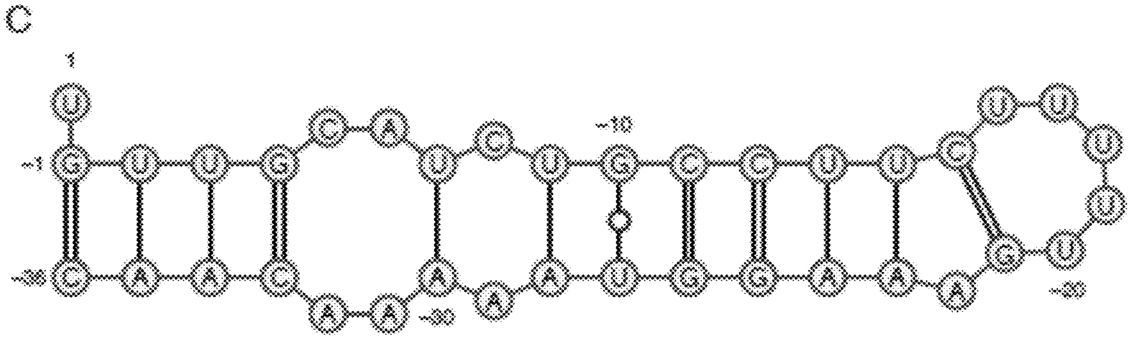
Figure 8D:
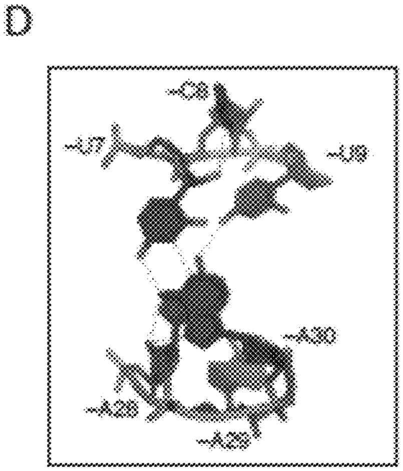
Figure 8E:
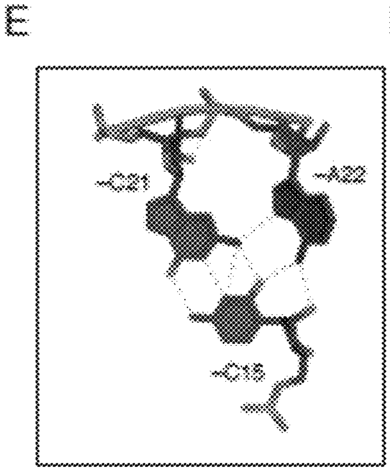
Figure 8F:
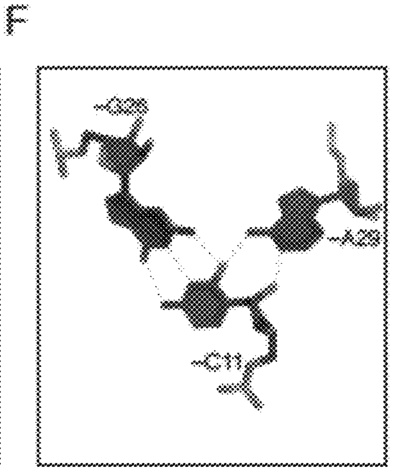
Figure 8G:
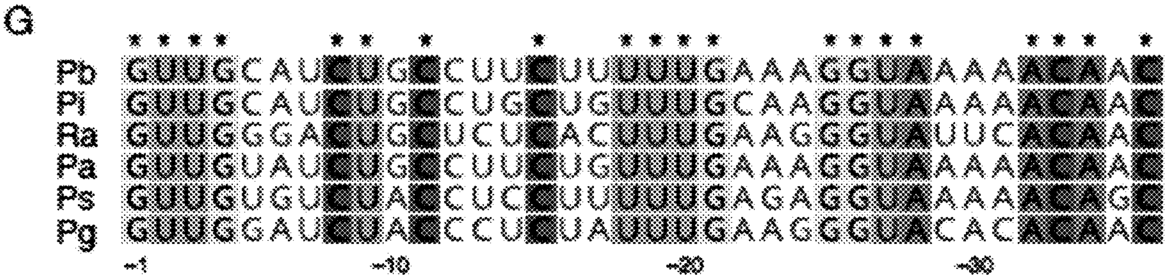
Figure 9:
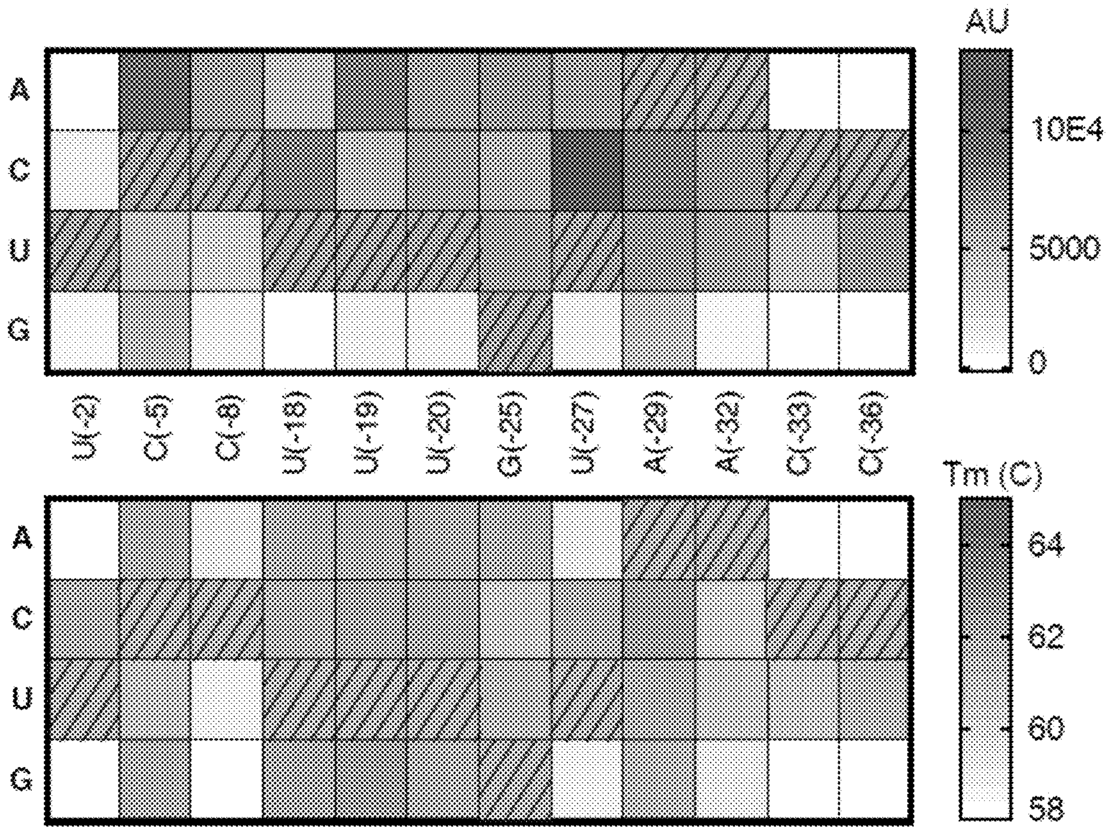
FIG. 9. Expanded data for cleavage activity of PbuCas13 with mutated crRNA, and thermal stability of crRNA mutants.
Figure 10A:
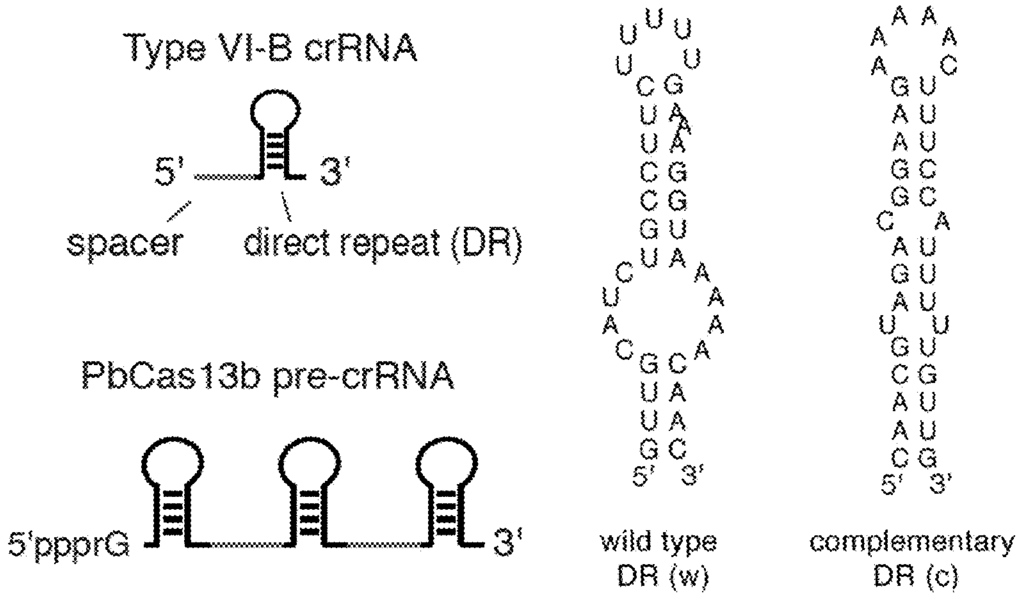
FIGS. 10A-10D.
Figure 10B:
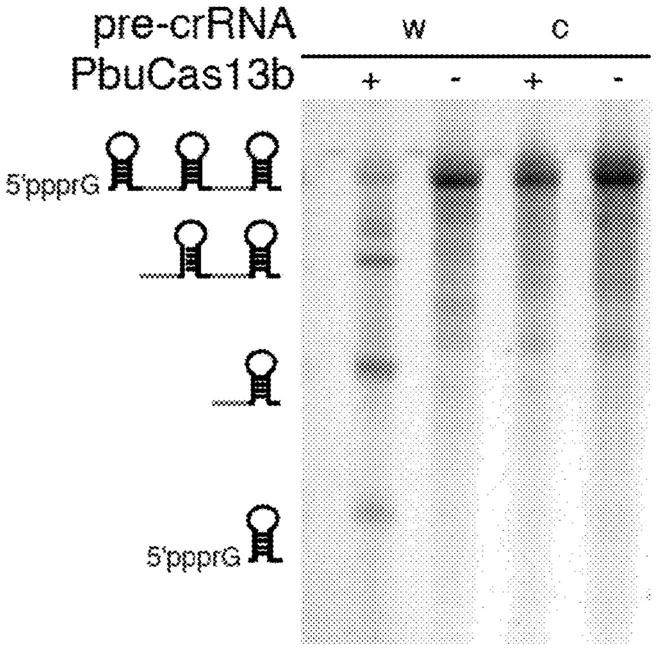
Figure 10C:
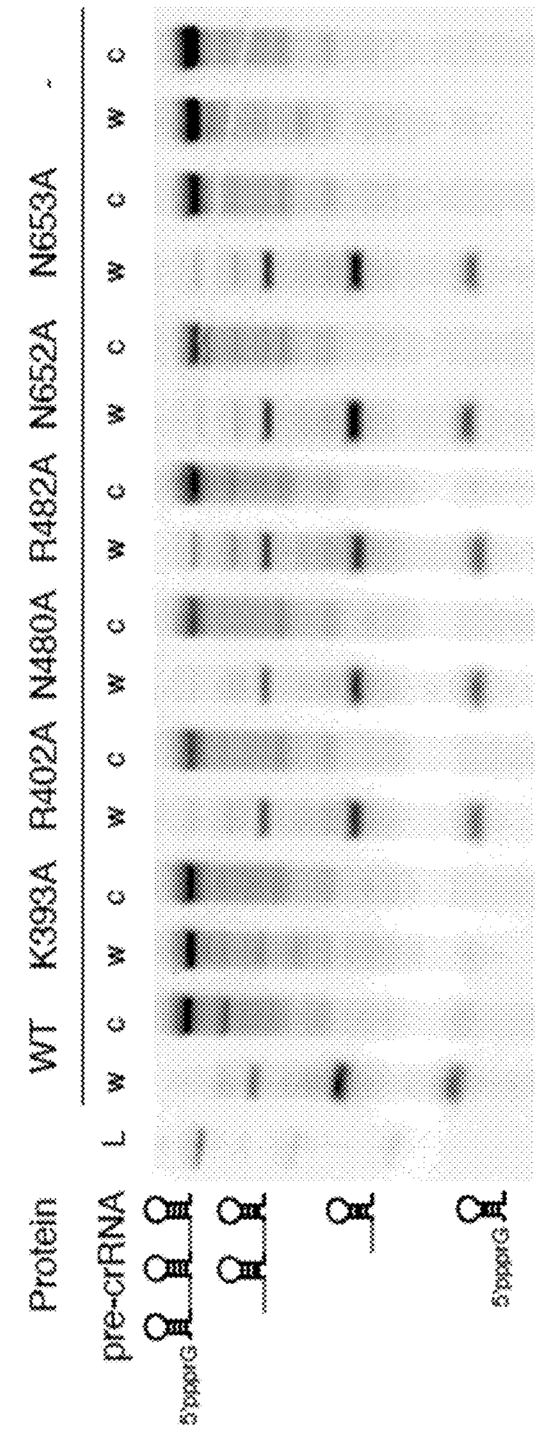
Figure 10D:
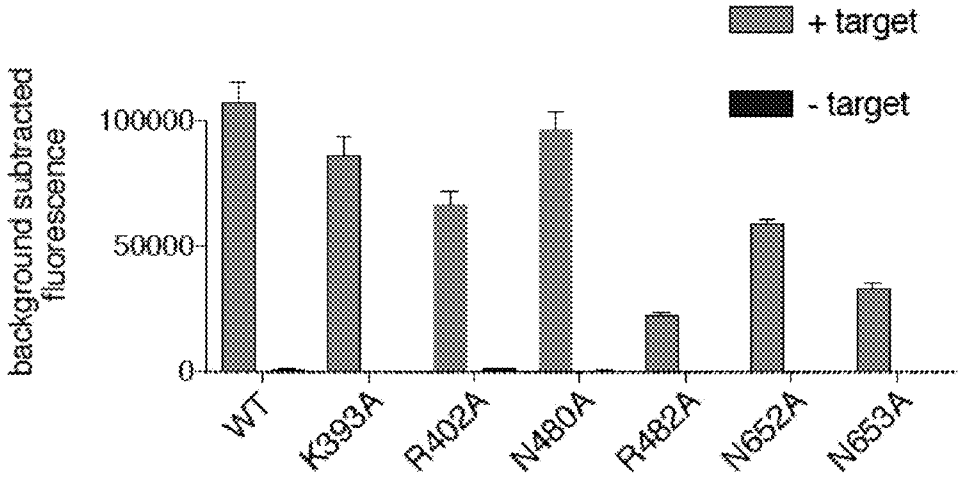

Three bases, C(−8), U(−20), and A(−29), were flipped out from the body of the RNA. The backbone carbonyl of T754 stabilized the flipped out, highly conserved C(−8) base by interacting with the base N4 amine, holding the base in a hydrophobic pocket of highly conserved residues (Y540, 566-571, K751, 753-761) in the Helical-1 and Helical-2 domains. The base flip was further stabilized by interaction between the C(−8) N3' and the sugar (O2') of U(−7). Changing C(−8) to G or U decreased nuclease activity, and destabilized the protein-RNA complex as measured in a thermal stability assay (FIG. 3). U(−20) was also absolutely conserved in Cas13b direct repeat sequences and was coordinated by completely conserved residues, most notably R762 which made contacts with the nucleobase O2, and R874 which intercalated between G(−21) and U(−20), holding the base out and making contacts with the U(−20) sugar O4'. Mutation of R762 to alanine dramatically reduced RNA interference in mammalian cells (FIG. 5A). Mutating U(−20) to G decreased nuclease activity (FIG. 3). In contrast to C(−8) and U(−20), A(−29) was not conserved in Cas13b direct repeat sequences and was the nucleobase was not coordinated by any amino acids. Instead, A(−29) engaged in multiplete base pairing with G(−26) and C(−11) (FIG. 8F) (22). A(−29) was tolerant to identity changes to any other base, but mutation to G slightly decreased general nuclease activity (FIG. 9). Base identity changes that affected general nuclease activity also decreased the thermal stability of the Cas13+crRNA complex. Consistent with this observation, Applicants found that changing the wobble base pair between U(−27) and G(−10) to a Watson crick base pair increased general nuclease activity (FIG. 2D). However, changing A(−32) to G, which also created a Watson crick base pair, decreased stability and reduced RNase activity (FIG. 2D).

The hairpin loop was recognized by a network of protein interactions from highly conserved residues within the Helical-2 domain (FIG. 3). K870 coordinated with 04 from both U(−16) and U(−19), which indirectly flipped U(−17) into the solvent at the hairpin turn, with no visible residue contacts. W842 stacked with the nucleobase of U(−18) while also interacting with the phosphate backbone together with K846. R877 and E873 further stabilized U(−18) through interactions with base N3 and O2 positions. R874 and R762 stabilized the U20 position through sugar O4' and base O2' interactions, respectively.

The hairpin loop distal end of the crRNA (−1 to −4 and −33 to −36) was helical and recognized by a combination of base and backbone interactions (FIG. 3). Notably, N653 and N652 made critical minor groove direct contacts with U(−2) and C(−36) and coordinated the 5' and 3' ends of the hairpin. Disruption of these base identities or mutation of N653 or N652 to alanine substantially decreased Cas13b activity in vitro and in mammalian interference assays (FIG. 2E, FIG. 5). C(−33) was coordinated by N756 via the nucleobase O2 and sugar O2', and changing this C to A or G abrogates general RNase activity and decreased protein stability (FIG. 2D, FIG. 9).

The RNA hairpin end (nucleotides −17 to −20) was stabilized by extensive phosphate backbone hydrogen bonding and base interactions (FIGS. 2, 3). Mutating U(−18) to G abolished general nuclease activity. The same was observed for U(−19), or U(−20) but other bases were tolerated, suggesting that the G O6 or N2 nucleobase atoms disrupted nuclease activity (FIG. 9).

Figure 5D:
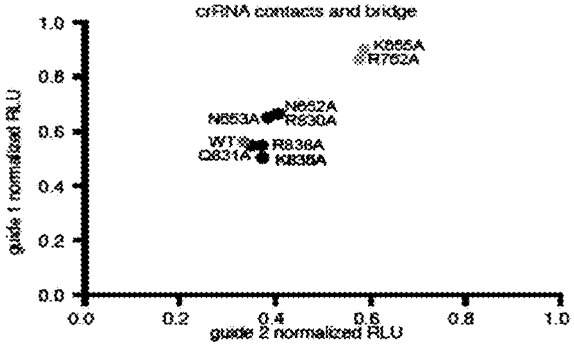
Figure 5E:
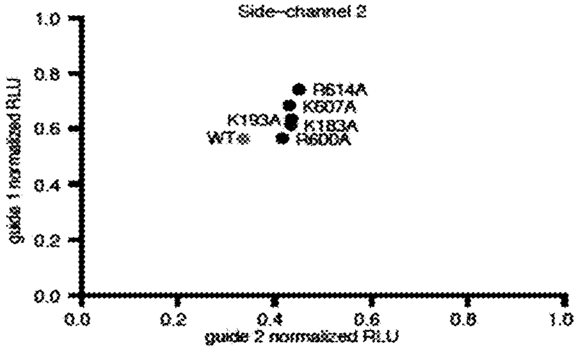
Figure 5F:
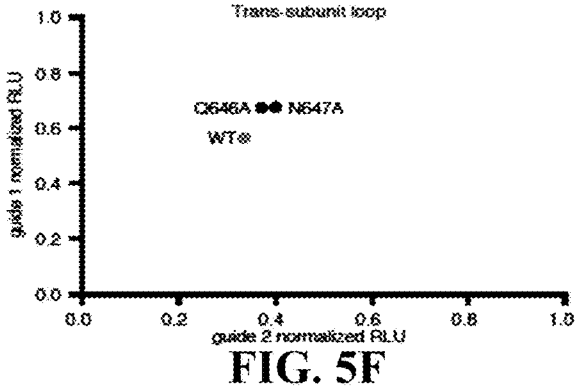
Figure 5G:
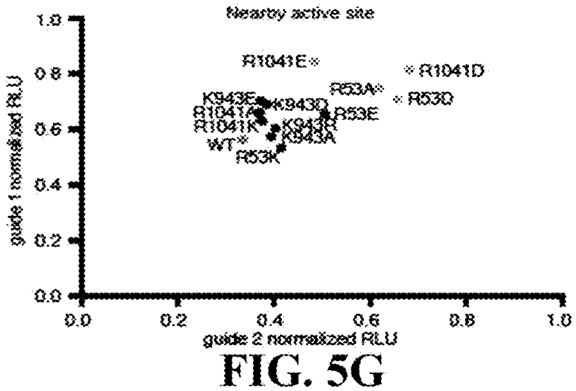
Figure 5H:
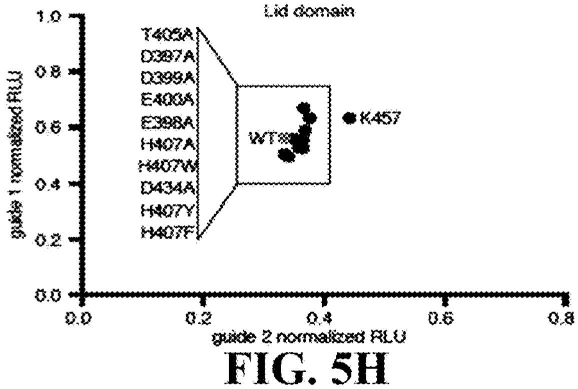

The crystallized RNA substrate included five bases of a spacer sequence (U1-G5), though only the first nucleotide 5' of the direct repeat was visible in the density. The 5' end of the RNA direct repeat and the first base of the spacer was supported by residues from Helical-2 and pointing up into the central channel and towards the side channel between the Lid and HEPN domains (FIG. 3). U(1) was not coordinated by base specific contacts, but was in a net positively charged pocket in the Lid domain. Mutation of charged and aromatic amino acids nearby the spacer U(1) had little effect on general nuclease activity, suggesting the spacer RNA coordination by these residues is either not present or not essential (FIG. 5H).

Some Class 2 CRISPR systems process long pre-crRNAs into mature crRNAs (3, 7, 11, 23). Cas13b has been shown to process its own crRNA at the 3' end (3). A number of highly conserved residues are in contact with or nearby the 3' end of the RNA and potentially form a second, non-HEPN nuclease site. To test for a second nuclease site, Applicants mutated four conserved residues nearby the 3' RNA end and tested these mutants for crRNA processing and target-activated nuclease activity (FIG. 2). K393 when mutated to alanine abrogates RNA processing but retains targeted nuclease activity, confirming the location of a second nuclease site in the Lid domain responsible for crRNA processing (FIGS. 2, 6, 10). R482A slightly affected crRNA processing, but significantly affected general nuclease activity. This is likely due to the importance of stabilizing the crRNA (FIG. 2).

Figure 11A:
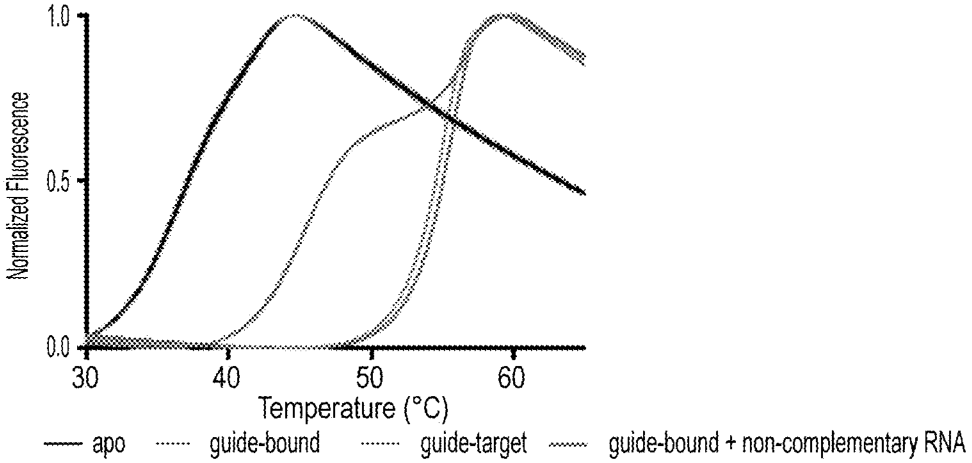
FIGS. 11A-11C. Melting curves of PbuCas13b with substrate RNA and Magnesium ions.
Figure 11B:
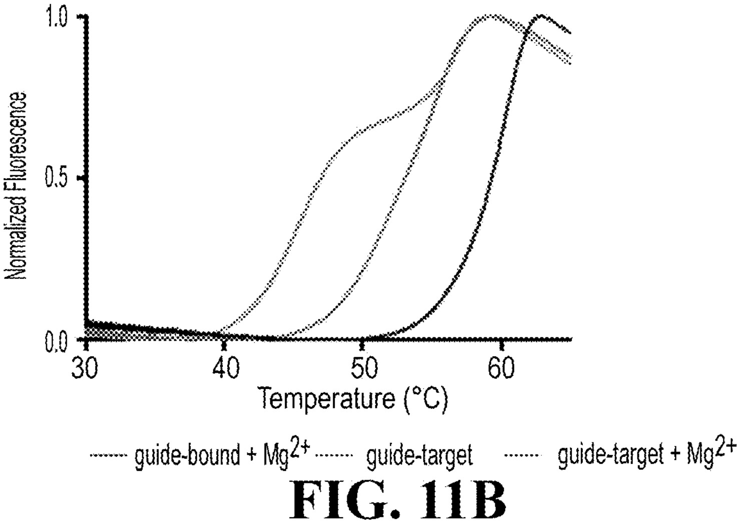
Figure 11C:
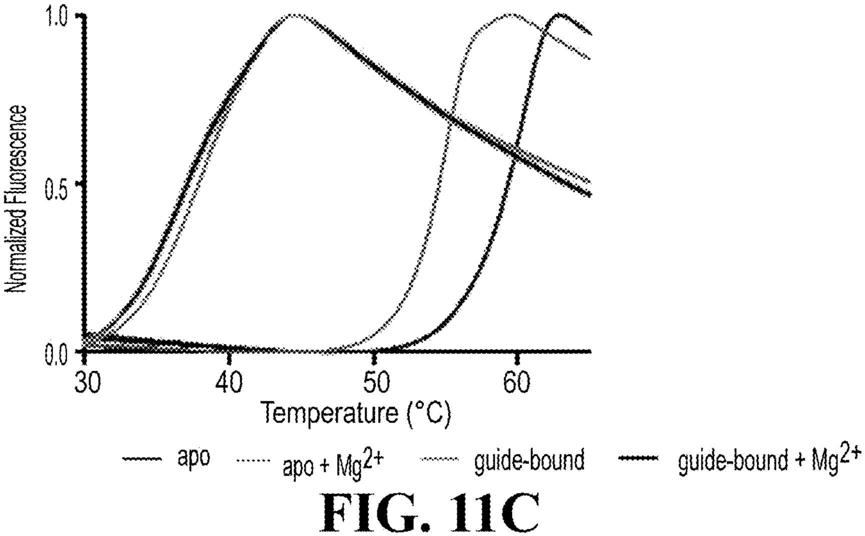
Figure 12:
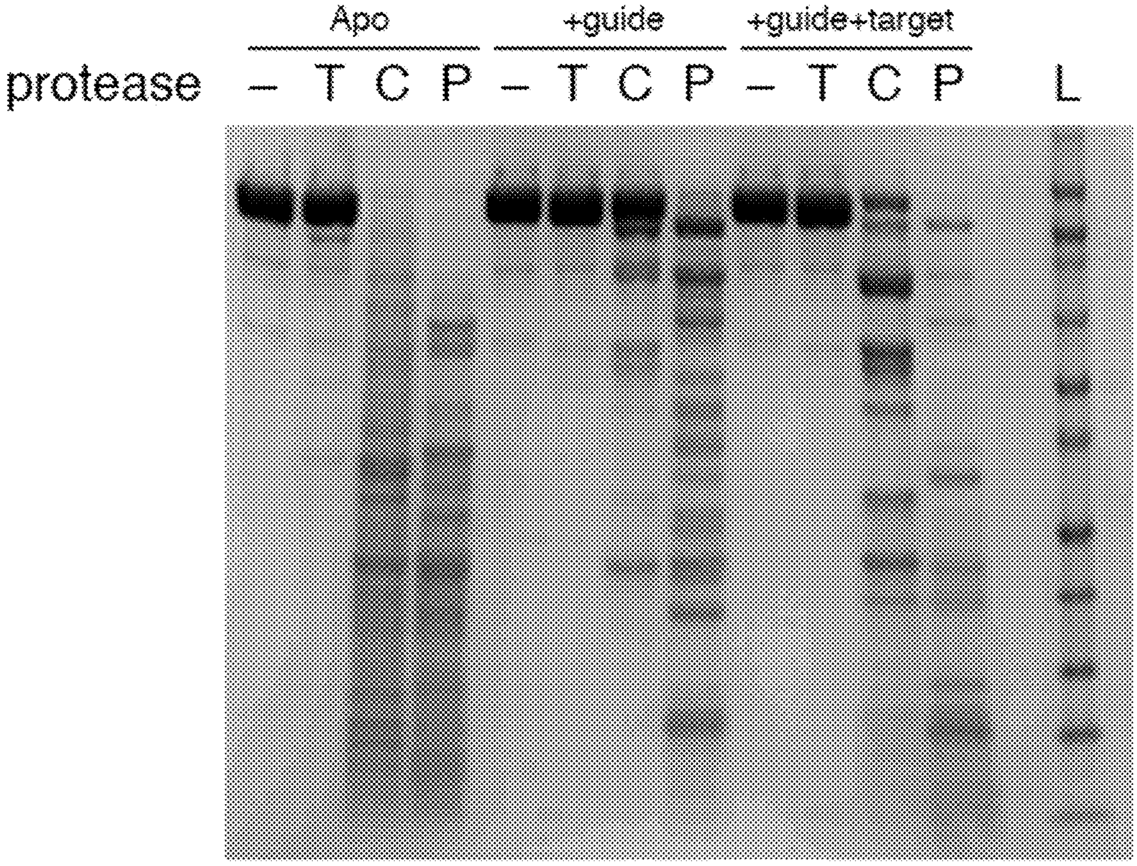
FIG. 12. Limited proteolysis of PbuCas13b with RNA substrate. Limited proteolysis of PbuCas13b. T=Trypsin, C=Chymotrypsin, P=Pepsin FIGS. 13A-13C. Cas13b bridge-helix.

The resolved spacer nucleotides pointed toward the HEPN lobes and into the positively charged channel. However, the channel was not large enough to accommodate an RNA duplex, suggesting that Cas13b adopted an open conformation in response to target binding. Applicants measured changes in Cas13b conformation in apo, guide, and guide+target RNA complexes using a thermal denaturation assay. Target-bound Cas13b adopted a less stable conformation compared to guide-only Cas13b, but this change was not observed in the presence of non-target RNA (FIG. 11). Limited proteolysis gave similar results; guide+target bound complexes were less protease resistant than guide only complex (FIG. 12).

Although there was a single molecule in the asymmetric unit of the crystal, a loop from one monomer made trans contacts with the another, coordinating a bound citrate from the crystallization buffer in the active site. To test if the trans-subunit contact is functional, and whether PbuCas13b functions cooperatively in trans via this loop, Applicants mutated the residues at the tip of this loop (Q646 and N647) to see if they would affect activity. Mutations of each decreased RNA interference in mammalian cells, suggesting the possibility of trans-subunit regulation of general nuclease activity (FIG. 5F).

Figure 4B:
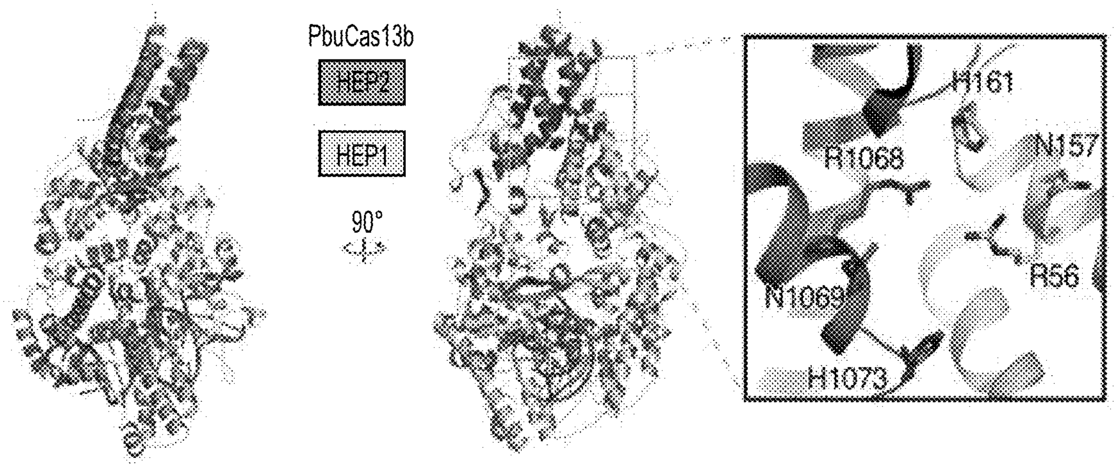
Figure 4C:
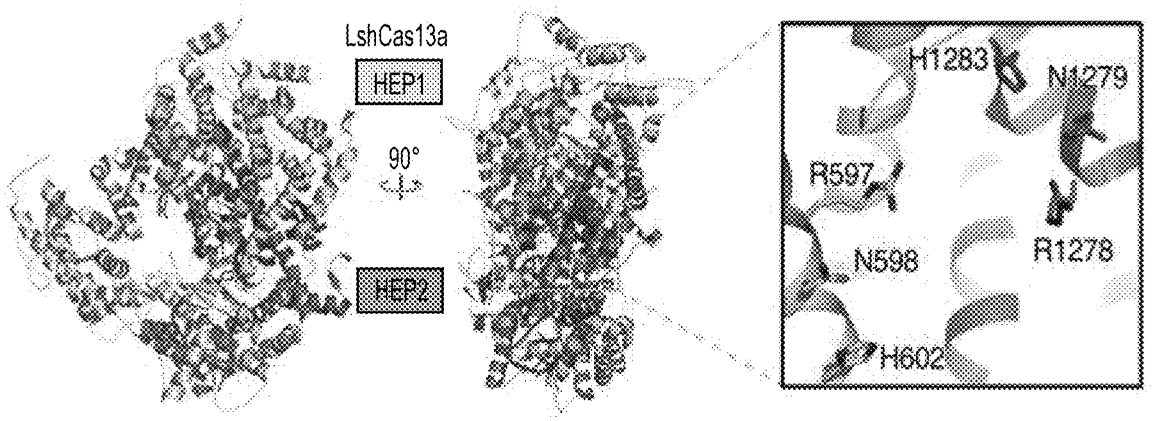
Figure 13A:
(FIG. 13A) Cas13b with bridge-helix highlighted in red. RNA is colored in pink.
Figure 13B:
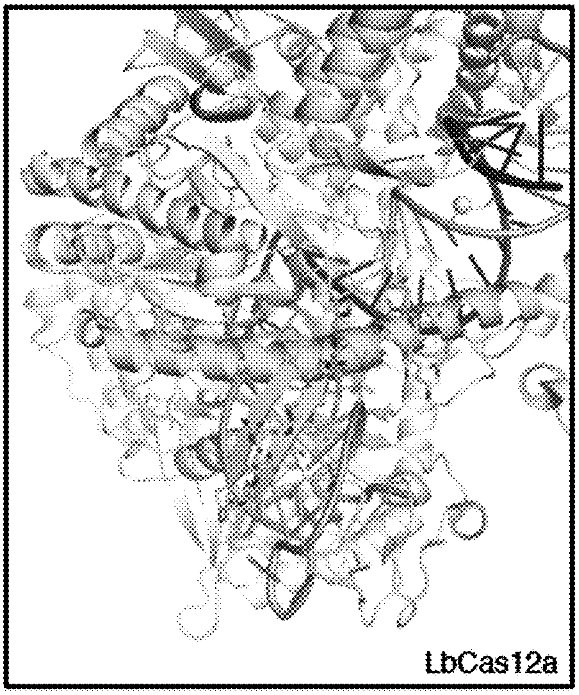
(FIG. 13B) Cas12(Cpf1) with bridge-helix highlighted in cyan. RNA is colored in light blue, DNA dark blue.
Figure 13C:
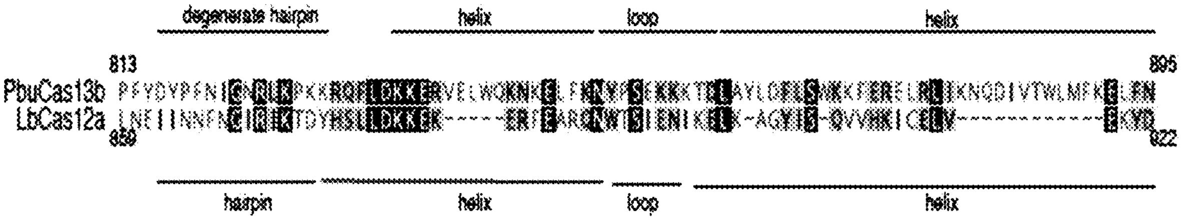
(FIG. 13C) Manual sequence alignment of bridge helix from PbuCas13b and LbCas12 (SEQ ID NOs:12-13).

Lastly, Applicants compared Cas13b to the structure of LshCas13a (FIG. 4) (17). In addition to general functional similarities between these family members, there were structural similarities between nucleases especially in the HEPN domains and active site architecture (FIGS. 4B,C). However, a SAS search provided a match to the crystal structure of (previously referred to as LbCpf1) and highlighted a bridge helix like sub-domain within Cas13b (24). Although this domain was poorly conserved within the Cas13b family, it appeared to be a common structural feature with Cas12a that mediated essential nucleic acid contacts (FIGS. 5D, 13). Given the fundamental differences between Cas13b and Cas12a, Applicants postulated that the bridge helix arose convergently and did not indicate a common ancestor for these two proteins. Nonetheless, Applicants referred to this feature as the bridge helix for consistency with the nomenclature of other Class 2 effectors (1, 14).

Table 11 below lists exemplary PbCas13b mutants which were produced and tested.

TABLE 11

List of mutations tested for RNA interference.
List of mutations and averaged normalized fluorescent values from three biological replicates.

| Mutation | Guide 1 normalized RLU | Guide 2 normalized RLU |
|---|---|---|
| R53A | 0.747858 | 0.618255 |
| R53K | 0.533437 | 0.415443 |
| R53D | 0.708809 | 0.656473 |
| R53E | 0.653859 | 0.505983 |
| Y164A | 0.560344 | 0.423418 |
| Y164F | 0.555361 | 0.419603 |
| Y164W | 0.578905 | 0.411809 |
| K183A | 0.611807 | 0.434156 |
| K193A | 0.637075 | 0.435537 |
| R285A | 0.621679 | 0.473138 |
| K292A | 0.709821 | 0.47966 |
| E296A | 0.753062 | 0.402674 |
| N297A | 0.697938 | 0.407599 |
| T405A | 0.668786 | 0.366621 |
| H407A | 0.541401 | 0.358297 |
| H407Y | 0.503637 | 0.335036 |
| H407W | 0.528546 | 0.359063 |
| H407F | 0.495551 | 0.341844 |
| K457A | 0.632984 | 0.441894 |
| H500A | 0.549885 | 0.34935 |
| K570A | 0.575468 | 0.362485 |
| K590A | 0.587262 | 0.383572 |
| R600A | 0.565624 | 0.417064 |
| K607A | 0.687397 | 0.430726 |
| R614A | 0.744806 | 0.450827 |
| N634A | 0.661617 | 0.386325 |
| R638A | 0.696471 | 0.410163 |
| Q646A | 0.675146 | 0.372062 |
| N647A | 0.677884 | 0.400227 |
| N652A | 0.665943 | 0.406755 |
| N653A | 0.650794 | 0.384887 |
| K655A | 0.900461 | 0.58631 |
| S658A | 0.625349 | 0.363679 |
| K741A | 0.648908 | 0.401644 |
| K744A | 0.651516 | 0.42232 |
| N756A | 0.650638 | 0.447333 |
| S757A | 0.618393 | 0.402225 |
| R762A | 0.862666 | 0.577076 |
| R791A | 0.644193 | 0.444169 |
| K826A | 0.600621 | 0.395086 |
| K828A | 0.619022 | 0.416127 |
| K829A | 0.593882 | 0.404272 |
| K846A | 0.576794 | 0.407463 |
| K857A | 0.595231 | 0.40528 |
| R877A | 0.683229 | 0.461362 |
| K943A | 0.573508 | 0.394379 |
| K943R | 0.60418 | 0.403167 |
| K943D | 0.69041 | 0.386955 |
| K943E | 0.702192 | 0.372508 |
| R1041A | 0.662393 | 0.371243 |
| R1041K | 0.629986 | 0.376016 |
| R1041D | 0.813623 | 0.680736 |
| R1041E | 0.842593 | 0.484389 |
| D397A | 0.63295 | 0.376658 |
| E398A | 0.557761 | 0.365275 |
| D399A | 0.590279 | 0.368724 |
| E400A | 0.560351 | 0.349016 |
| D434A | 0.524497 | 0.364659 |
| R618A | 0.611197 | 0.401871 |
| R830A | 0.663284 | 0.405163 |
| Q831A | 0.548391 | 0.351777 |
| K835A | 0.503864 | 0.373504 |
| K836A | 0.503571 | 0.374439 |

TABLE 11-continued

| List of mutations tested for RNA interference. List of mutations and averaged normalized fluorescent values from three biological replicates. | | |
|---|---|---|
| Mutation | Guide 1 normalized RLU | Guide 2 normalized RLU |
| R838A | 0.549749 | 0.372399 |
| WT | 0.563282 | 0.335038 |

The structure of PbuCas13b provided new information on the structural diversity of the type VI protein family and highlighted the differences and similarities between Cas13a and b. Applicants show the structural basis for crRNA recognition and processing and revealed key regulators of nuclease activity in both the guide RNA and protein. Based on the structure of PbuCas13b, Applicants were able to generate a smaller variant of the REPAIR platform that maintained base editing efficiency and could be packaged into AAV. Our data suggests a major domain reconfiguration occurs during target recognition. Insights from the structure of PbuCas13b enabled rational engineering to improve functionality for RNA targeting specificity, base editing, and nucleic acid detection (11, 12, 25, 26).

Example 2

Figure 19:
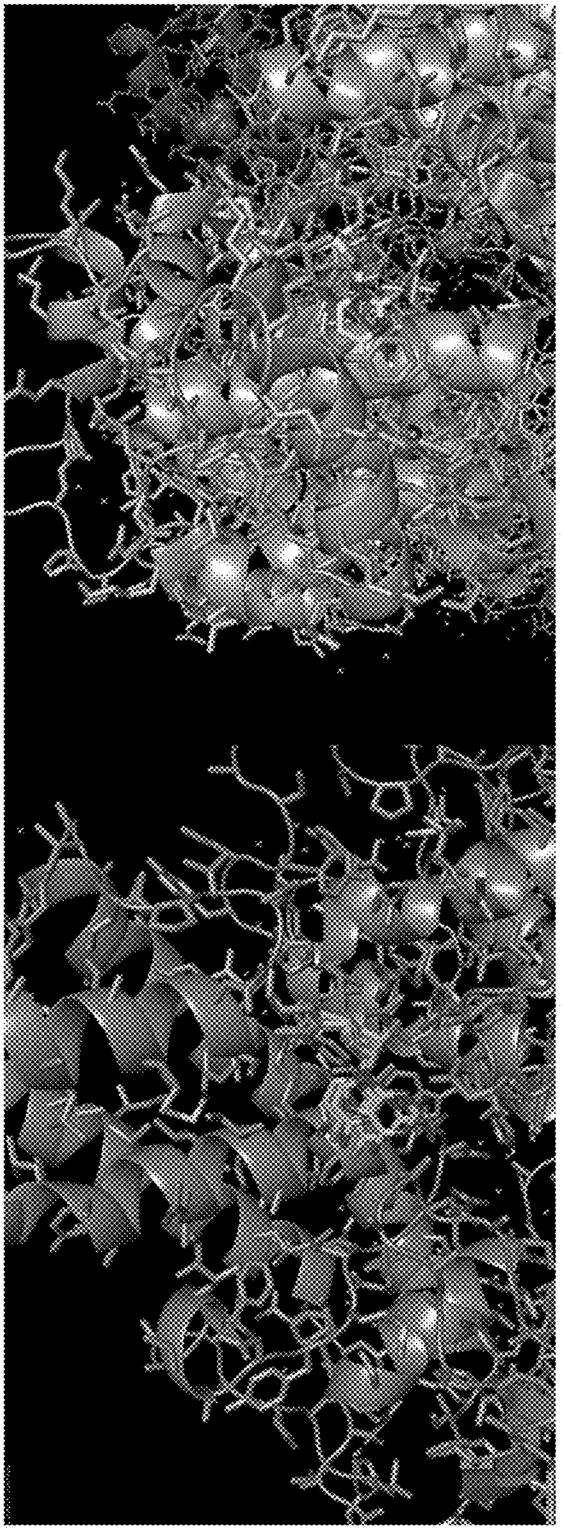
FIG. 19 shows a pymol file that shows a position of the coordinated nucleotide in the active site of Cas13b.

FIG. 19 shows a pymol file that shows a position of the coordinated nucleotide in the active site of Cas13b. This is a structural alignment based on a crystal structure of RNAseL in complex with U nucleotide. This alignment placed the nucleotide within the active site of Cas13b and revealed likely residue interactions. Loops involved in base specificity are annotated in the figure.

Example 3

Figure 20:
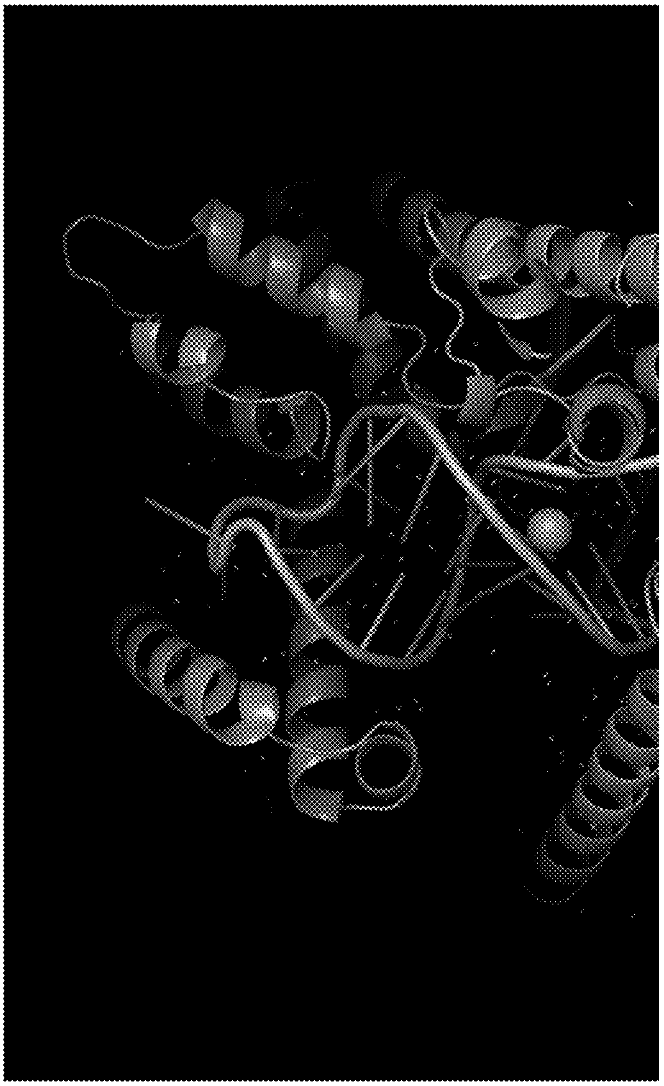
FIG. 20 shows an exemplary RNA loop extension.

The RNA loop may be extended. The extended RNA guide loop may add functional RNA motifs. FIG. 20 shows an exemplary RNA loop extension.

Example 4

Figure 21:
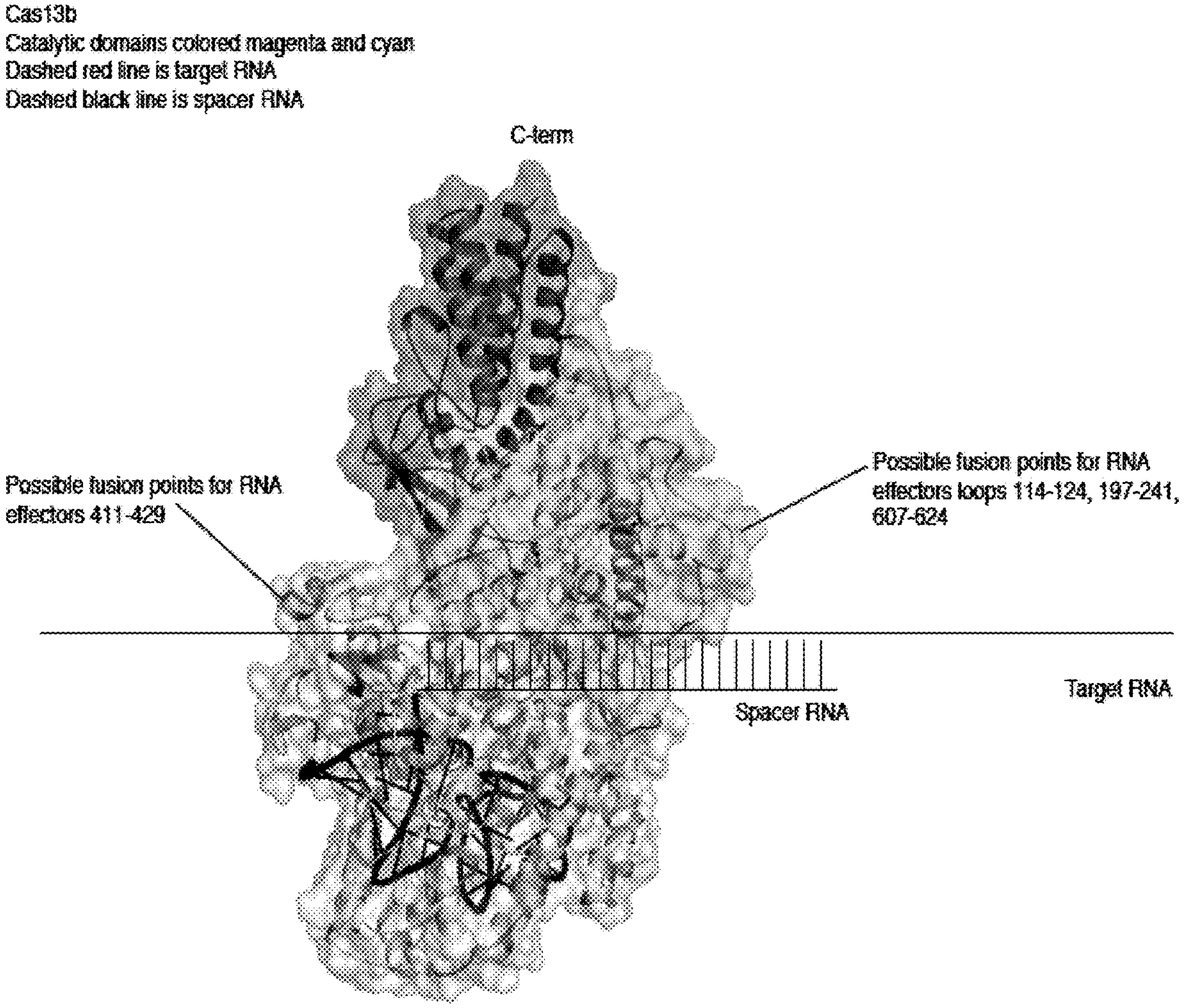
FIG. 21 shows exemplary fusion points via which a nucleotide deaminase is linked to a Cas13b.

FIG. 21 shows exemplary fusion points via which a nucleotide deaminase is linked to a Cas13b. The fusion points may be one or more amino acids on Cas13b. For example, the fusion points may be one or more of amino acids 411-429, 114-124, 197-241, and 607-624. In one example, the amino acids are in *Prevotella buccae* Cas13b.

Example 5

Mutations in ADAR affecting ADAR activity were screened using yeast screening. The screen was performed in multiple rounds. Each round of screening yielded a set of candidate mutations. The candidate mutations were then validated in mammalian cells. The top-performing mutations were added to the last version of mutations and re-screened. The mutations screened in 10 rounds are shown in the table below. The mutant identified in round n was designated as "RESCUE vn−1." As discussed herein RESCUE refer to mutations that convert adenosine deaminase activity to cytidine deaminase activity.

TABLE 12

| RESCUE Round | ADAR mutations | Plasmid |
|---|---|---|
| RESCUEv0 | E488Q | pAB0048 |
| RESCUEv1 | E488Q, V351G | pAB0359 |
| RESCUEv2 | E488Q, V351G, S486A | pAB1188 |
| RESCUEv3 | E488Q, V351G, S486A, T375S | pAB0642 |
| RESCUEv4 | E488Q, V351G, S486A, T375S, S370C, | pAB1072 |
| RESCUEv5 | E488Q, V351G, S486A, T375S, S370C, P462A | pAB1135 |
| RESCUEv6 | E488Q, V351G, S486A, T375S, S370C, P462A, N597I | pAB1146 |
| RESCUEv7 | E488Q, V351G, S486A, T375S, S370C, P462A, N597I, L332I | pAB1194 |
| RESCUEv8 | E488Q, V351G, S486A, T375S, S370C, P462A, N597I, L332I, I398V | pAB1220 |
| RESCUEv9 | E488Q, V351G, S486A, T375S, S370C, P462A, N597I, L332I, I398V, K350I | pAB1327 |

Figure 22:
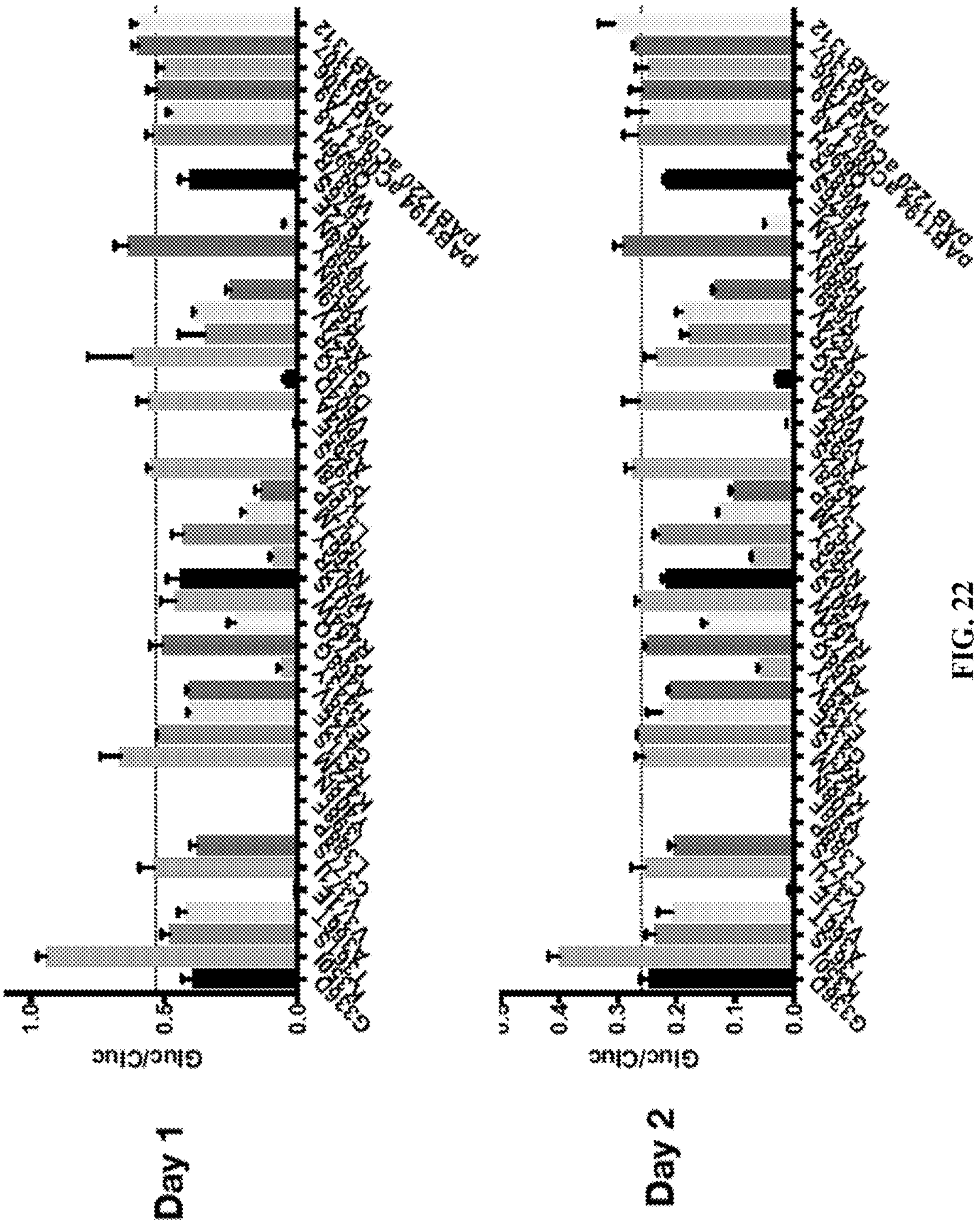
FIG. 22 shows screening for mutations for RESCUE v9.
Figure 23A:
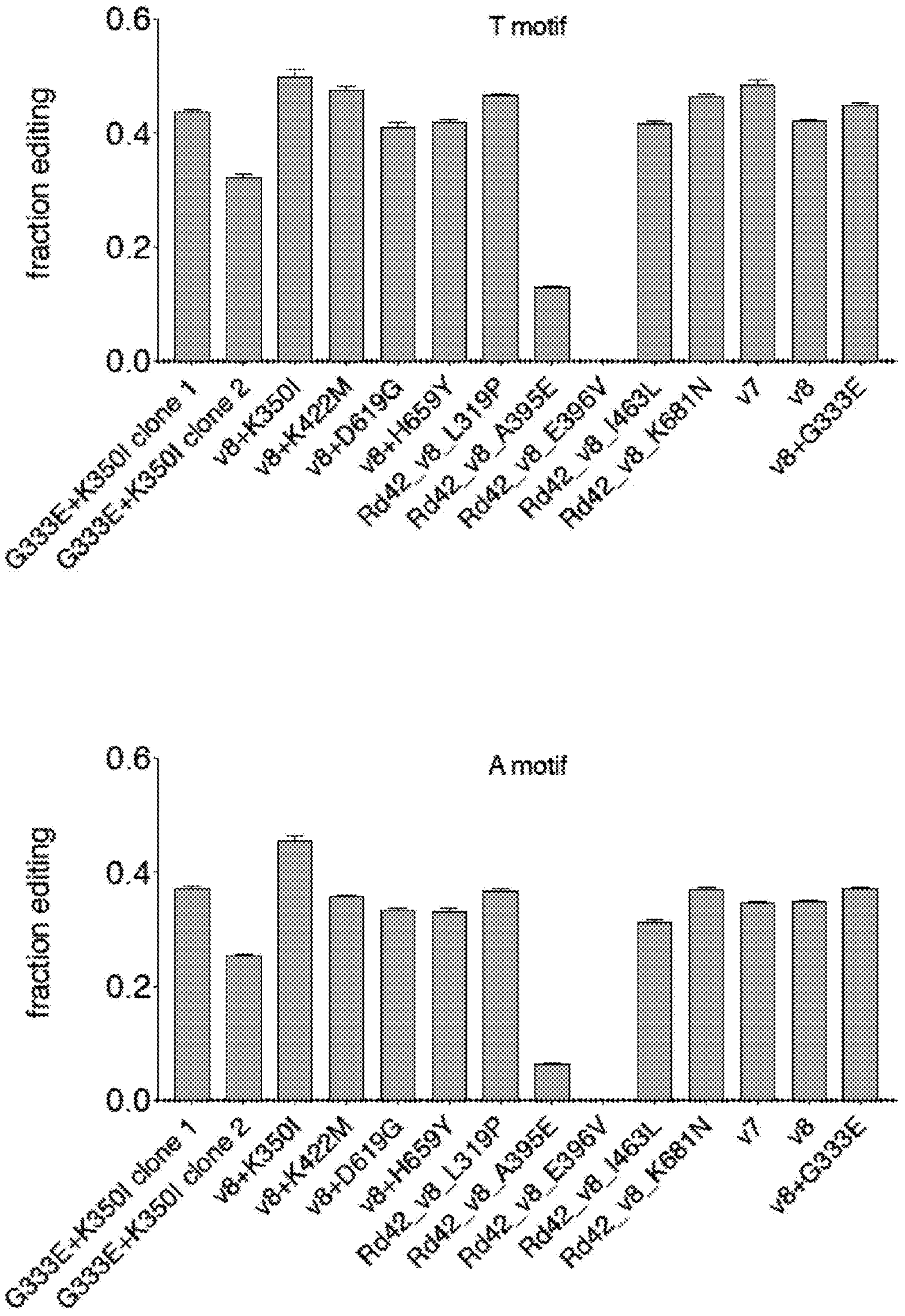
FIG. 23 shows validation of RESCUEv9's effect on T-flip guides.
Figure 25:
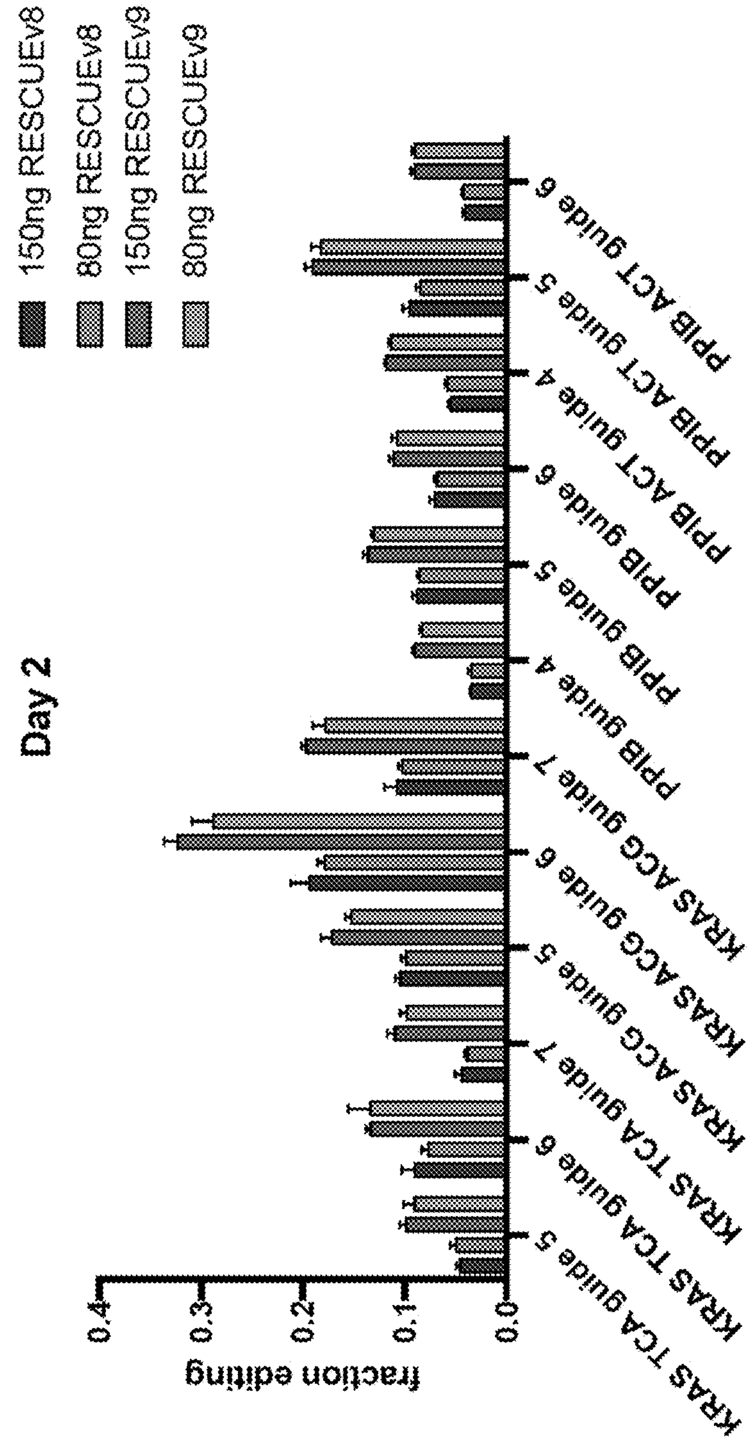
FIG. 25 shows performance of RESCUEv9 on endogenous targeting.

Screening for mutations for RESCUE v9 was performed (FIG. 22). Effects of RESCUEv9 were validated on T-flip guides (FIG. 23) and C-flip guides (FIG. 24). At least about 60% editing for T, A, and C motifs and 25% editing for the G motif were achieved with RESCUEv9. Performance of RESCUEv9 was tested with endogenous targeting (with T-flip guides) (FIG. 25).

Figure 26:
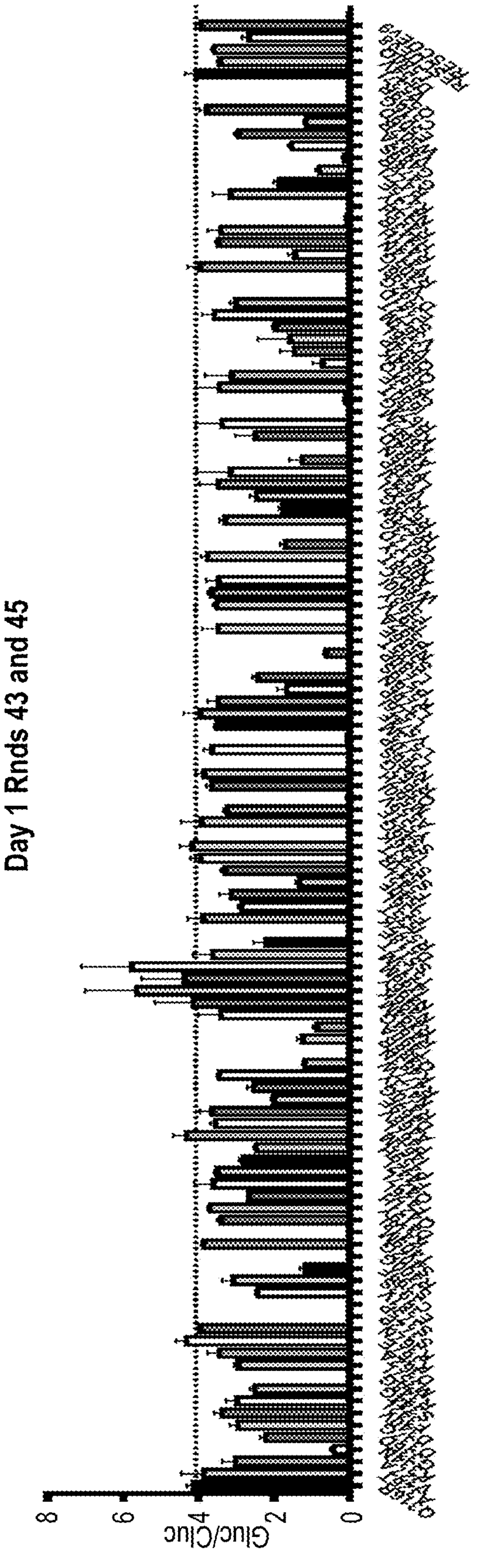
FIG. 26 shows screening for mutations for RESCUEv10.

Screening for mutations for RESCUE v10 was performed (FIG. 26).

Figure 27:
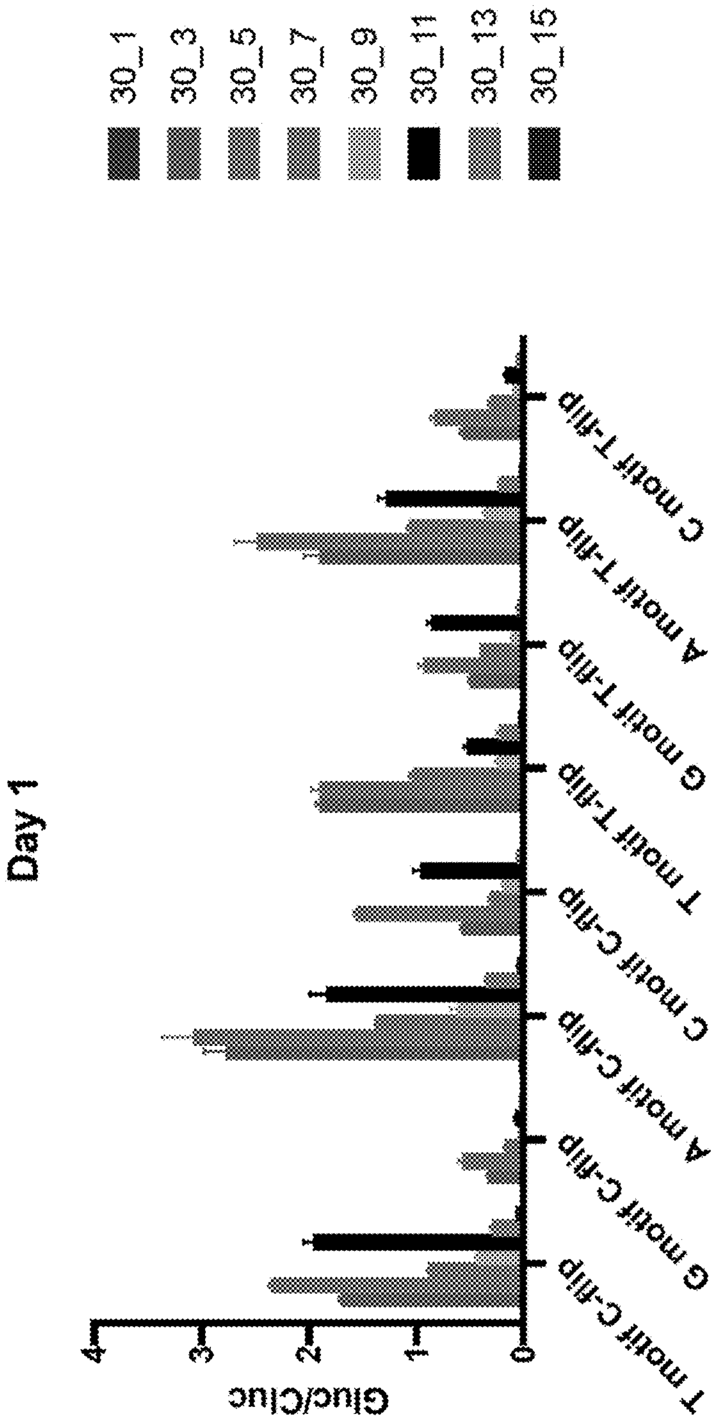
FIG. 27 shows test results of 30-bp guides for C-flips.

30-bp guides were tested for C-flips (FIG. 27).

Figure 28:
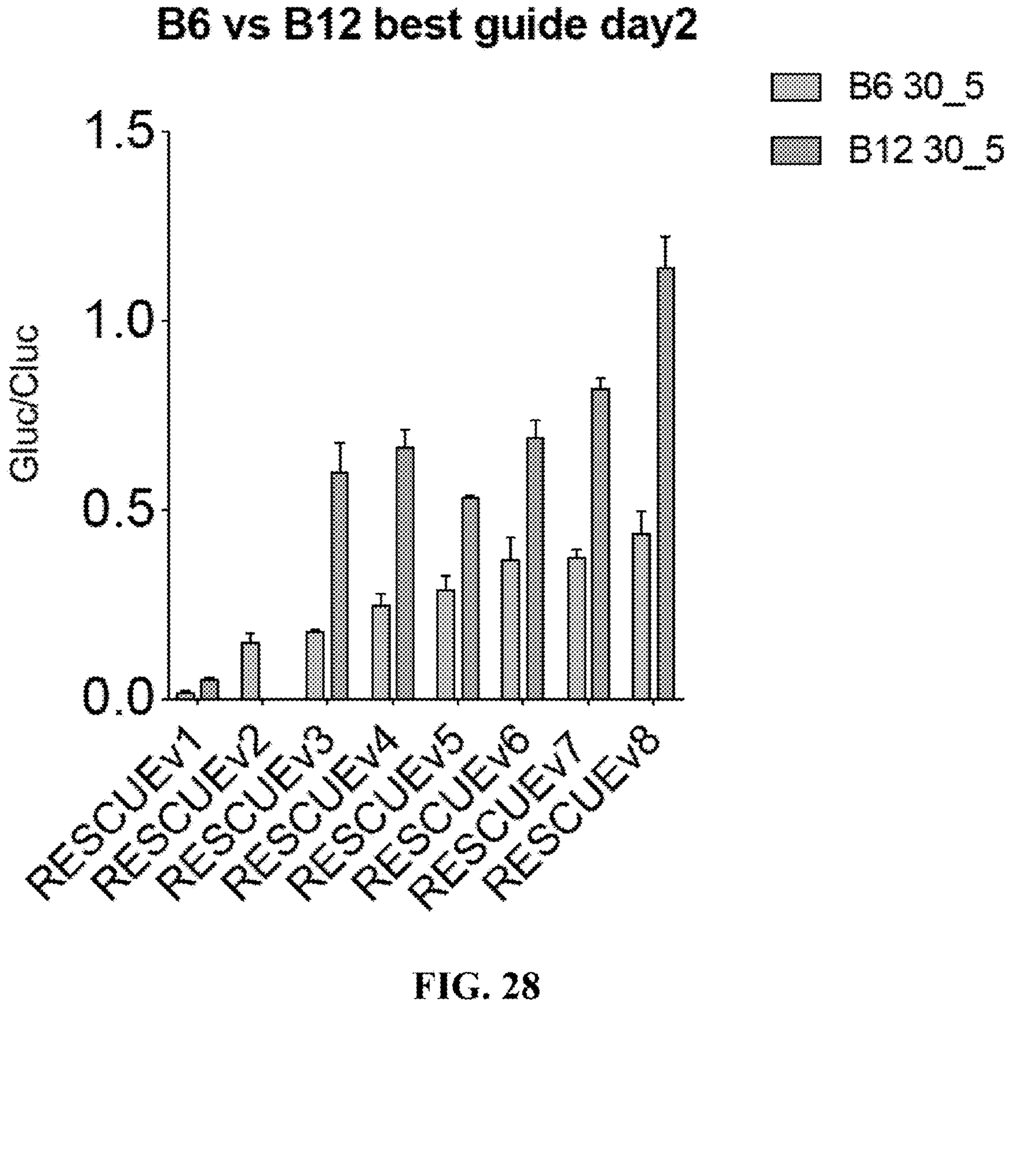
FIG. 28 shows Gluc/Cluc results from comparison between Cas13b6 and Cas13b12 with RESCUE v1 through v8.
Figure 29:
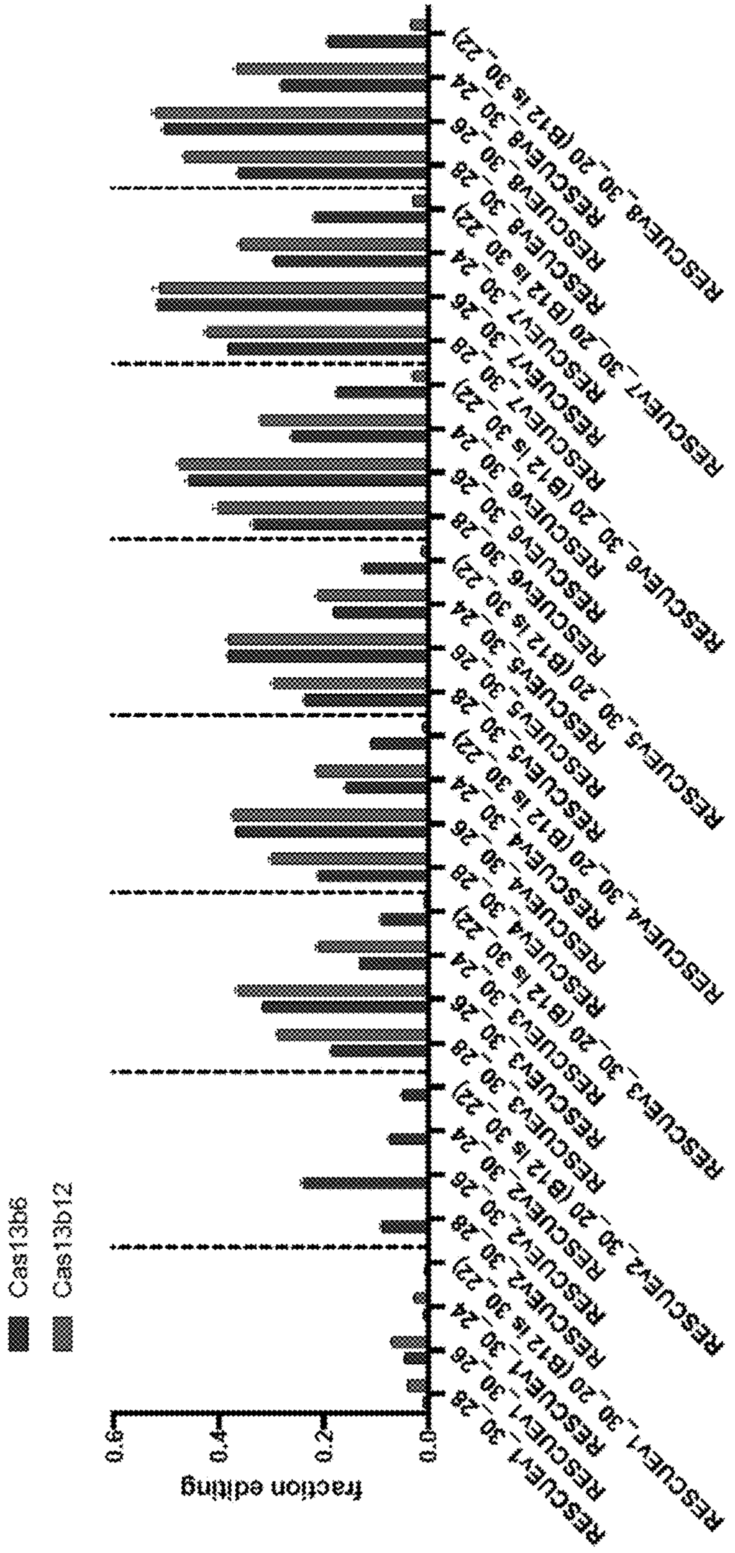
FIG. 29 shows fraction editing results from comparison between Cas13b6 and Cas13b12 with RESCUE v1 through v8.
Figure 30A:
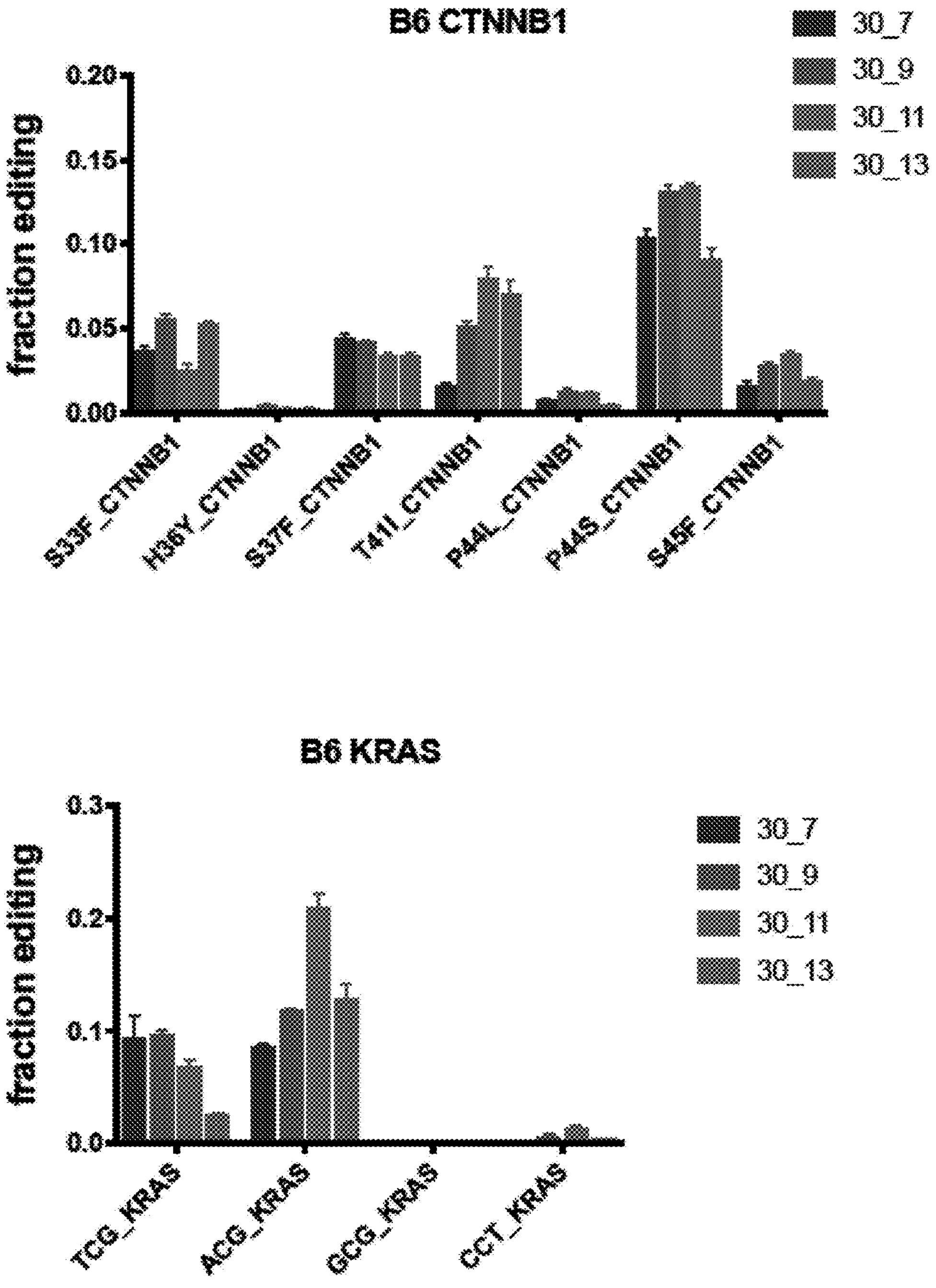
FIG. 30 shows effects on endogenous targeting (T-flips) results from comparison between Cas13b6 and Cas13b12 with RESCUEv8.
Figure 30C:
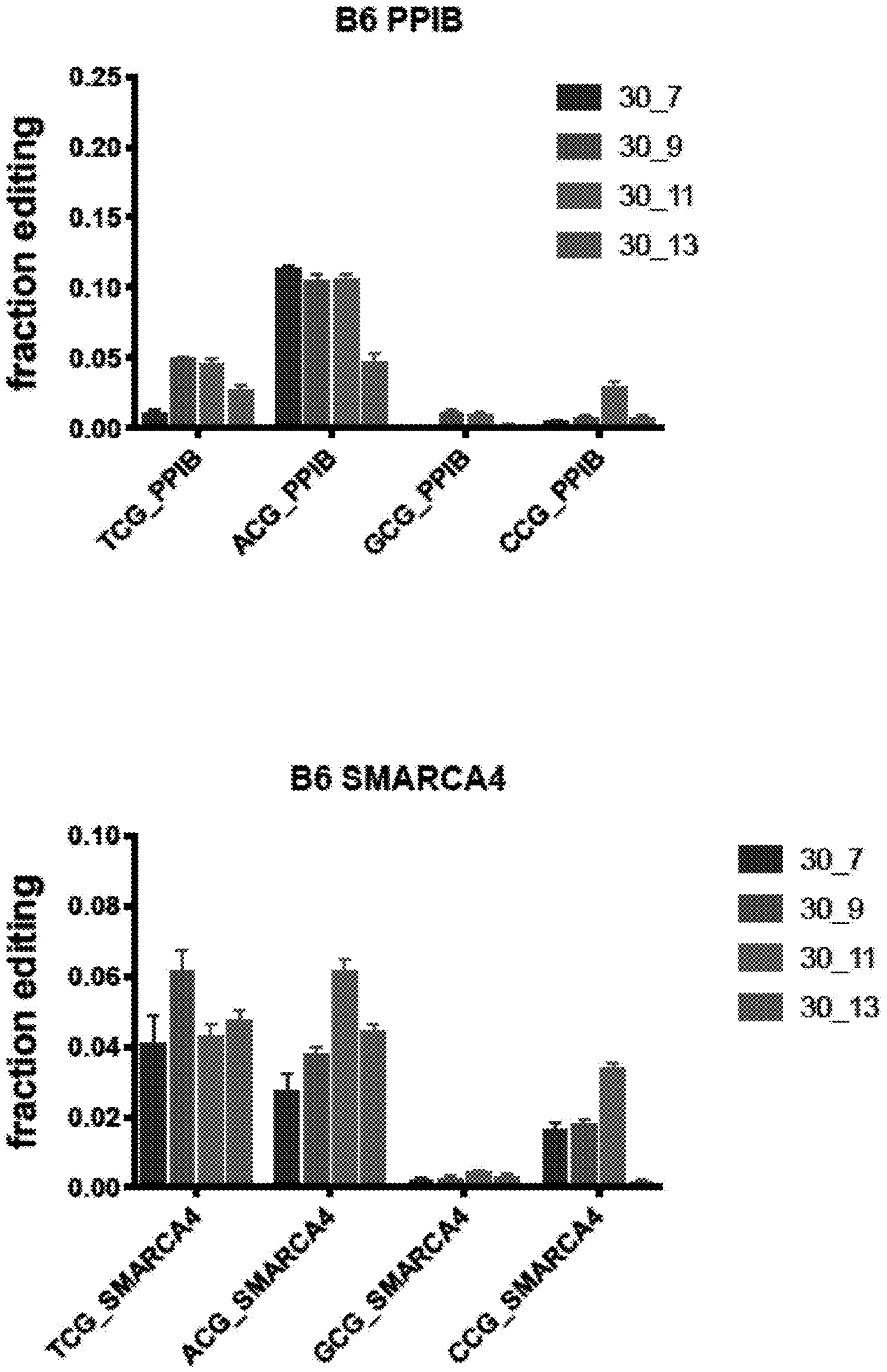

Comparison between Cas13b6 and Cas13b12 with RESCUE v1 through v8 were performed. Gluc/Cluc results are shown in FIG. 28, fraction editing results are shown in FIG. 29, and effects on endogenous targeting (T-flips) with RESCUEv8 are shown in FIG. 30.

Figure 31A:
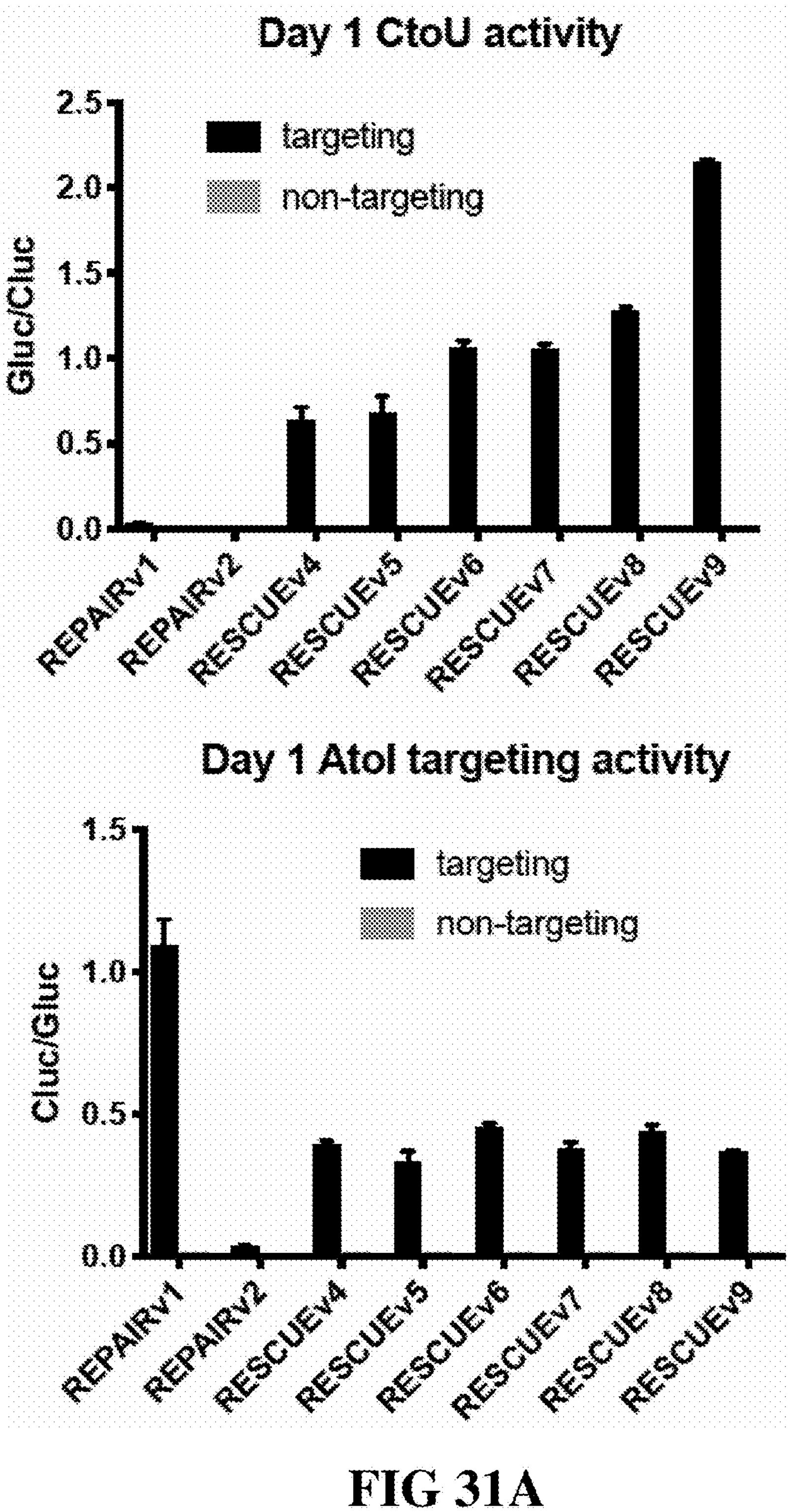
FIG. 31 shows effects of RESCUEs on base converting.
Figure 31B:
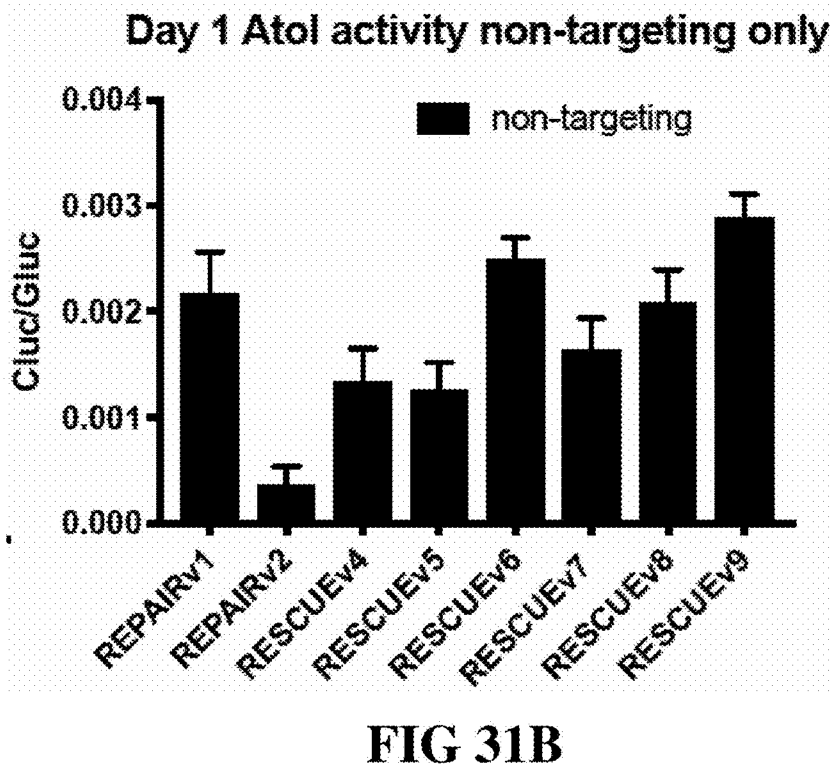
Figure 32:
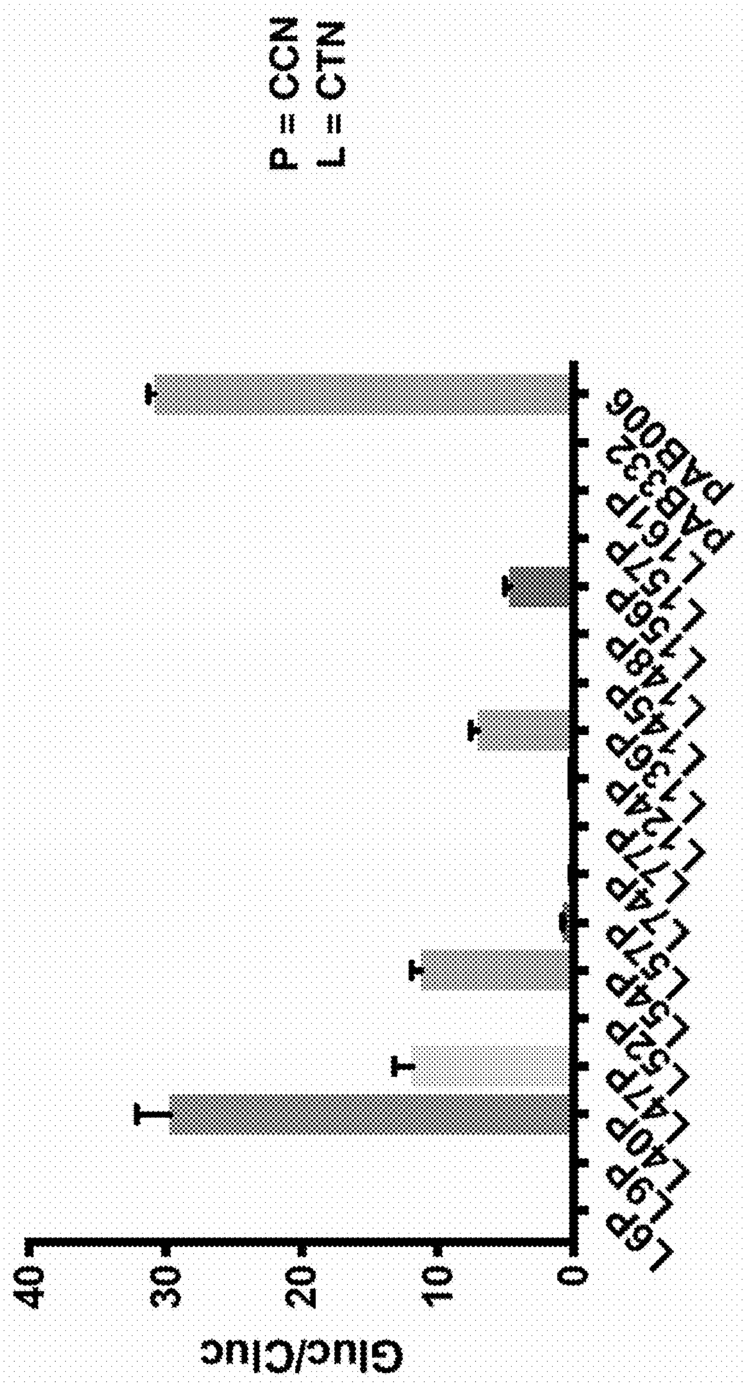
FIG. 32 shows test results of CCN 3' motif targeting.

Effects of RESCUEs on base converting (C to U and A to I activities) were compared (FIG. 31). CCN 3' motif targeting was tested (FIG. 32).

Example 6

Figure 33A:
FIG. 33A shows a schematic of constructs with dCas13b fused with ADAR.
Figure 33B:
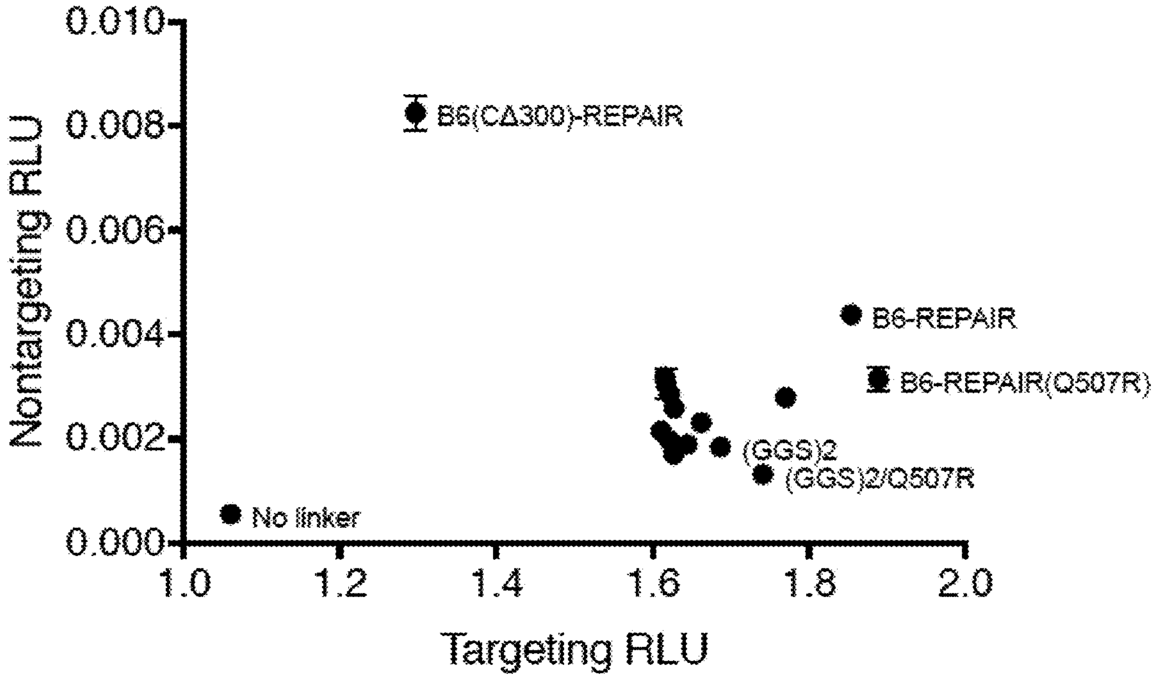
FIG. 33B shows test results of the constructs.
Figure 34:
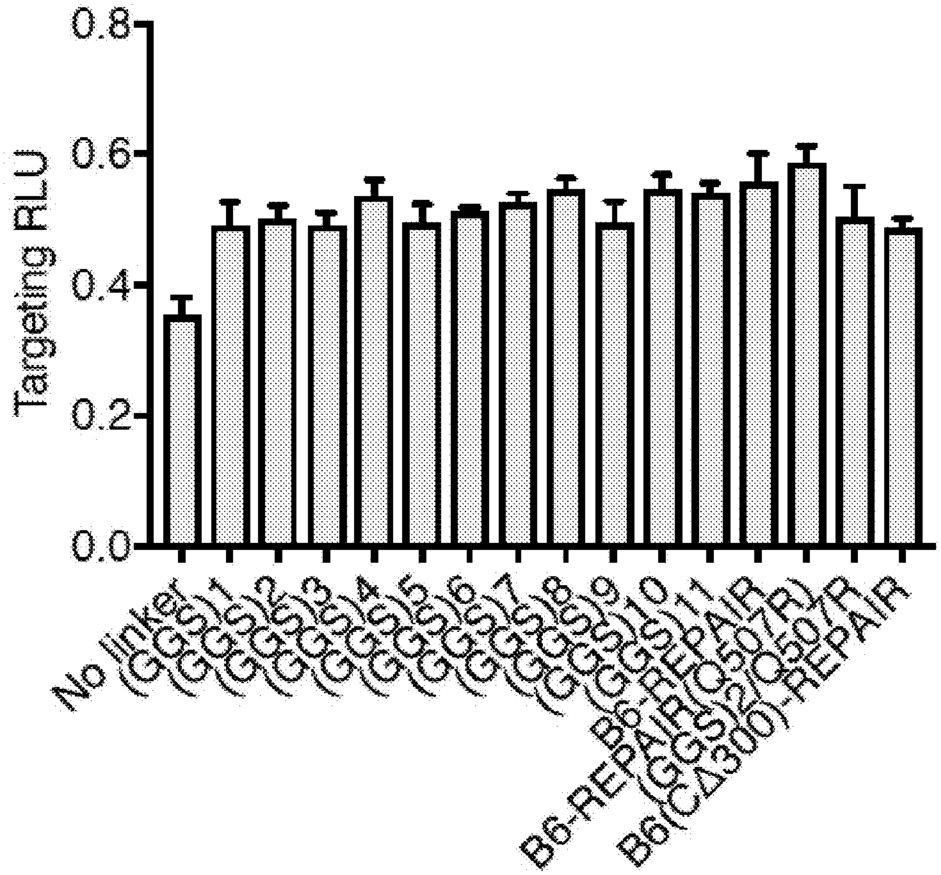
FIG. 34 shows sequencing of the N-terminal tag and linkers.

Constructs with various dead Cas13b (including dCas13b) fused with ADAR via a linker were generated (FIG. 33A) and tested (FIG. 33B). The constructs also had an N-terminal tag (HIVNES). Sequencing of the N-terminal tag and linkers were performed (FIG. 34).

Figure 35:
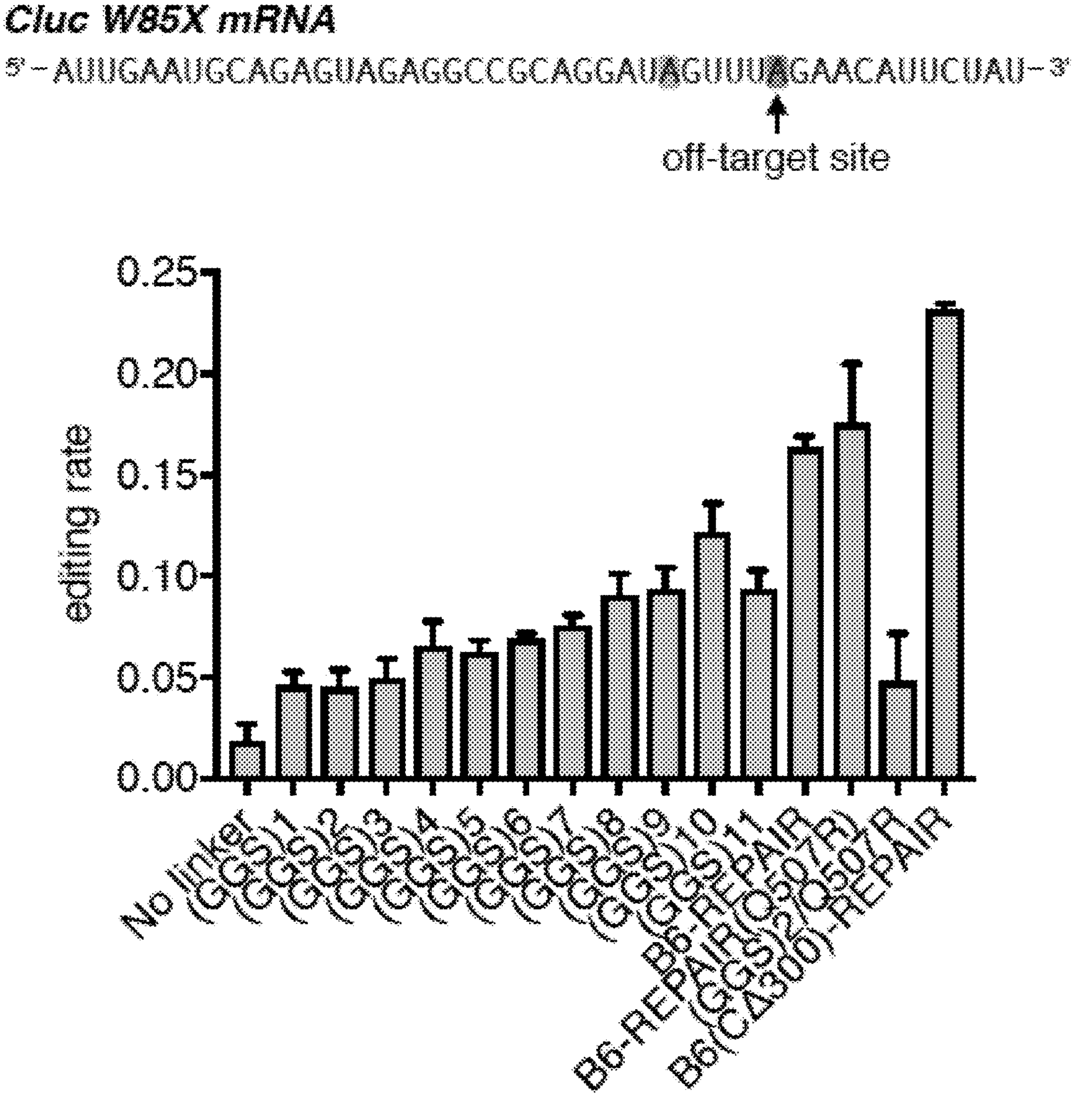
FIG. 35 shows quantification of off-targets.
Figure 36:
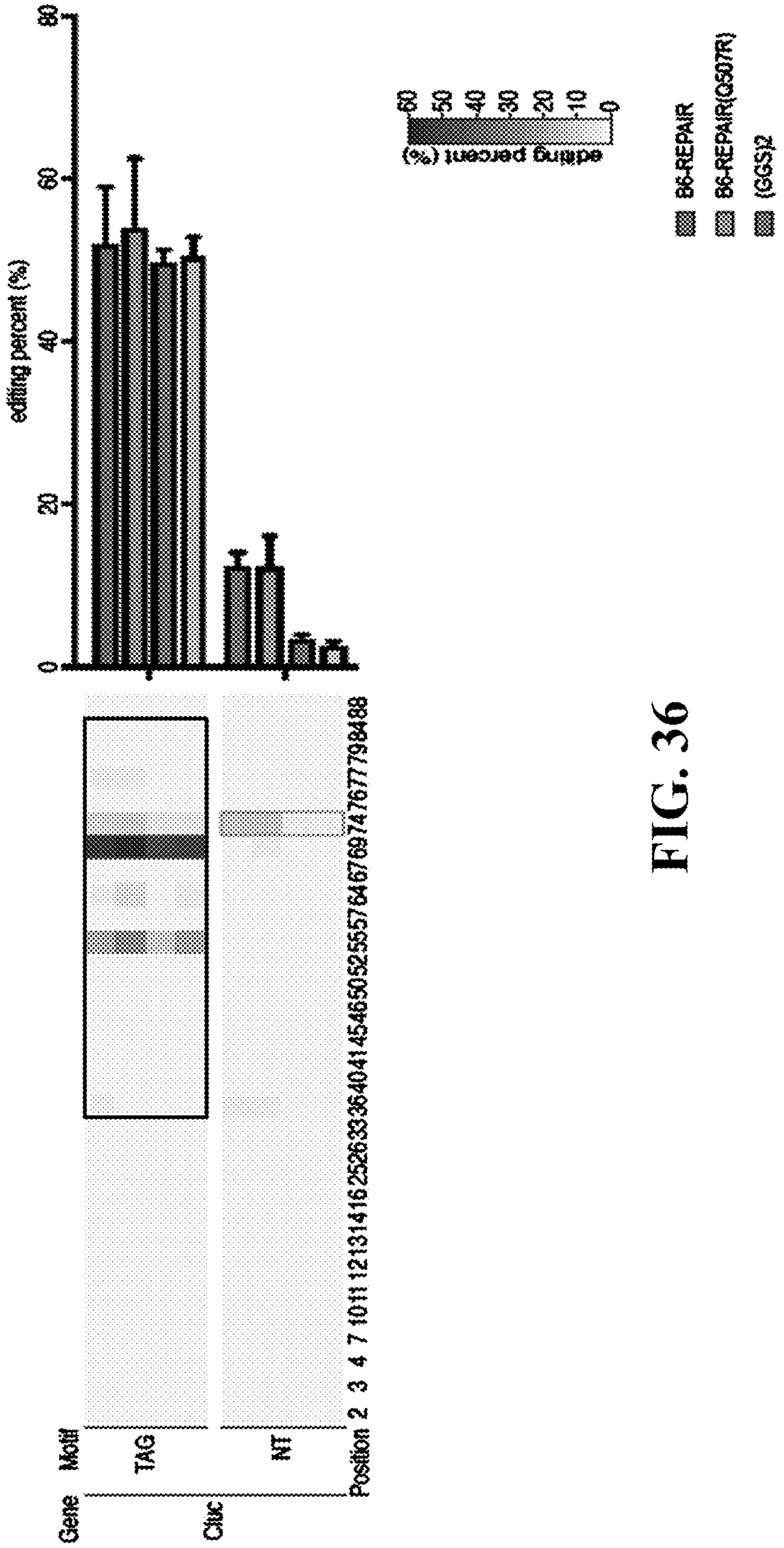
FIG. 36 shows testing of off-target edits.
Figure 37A:
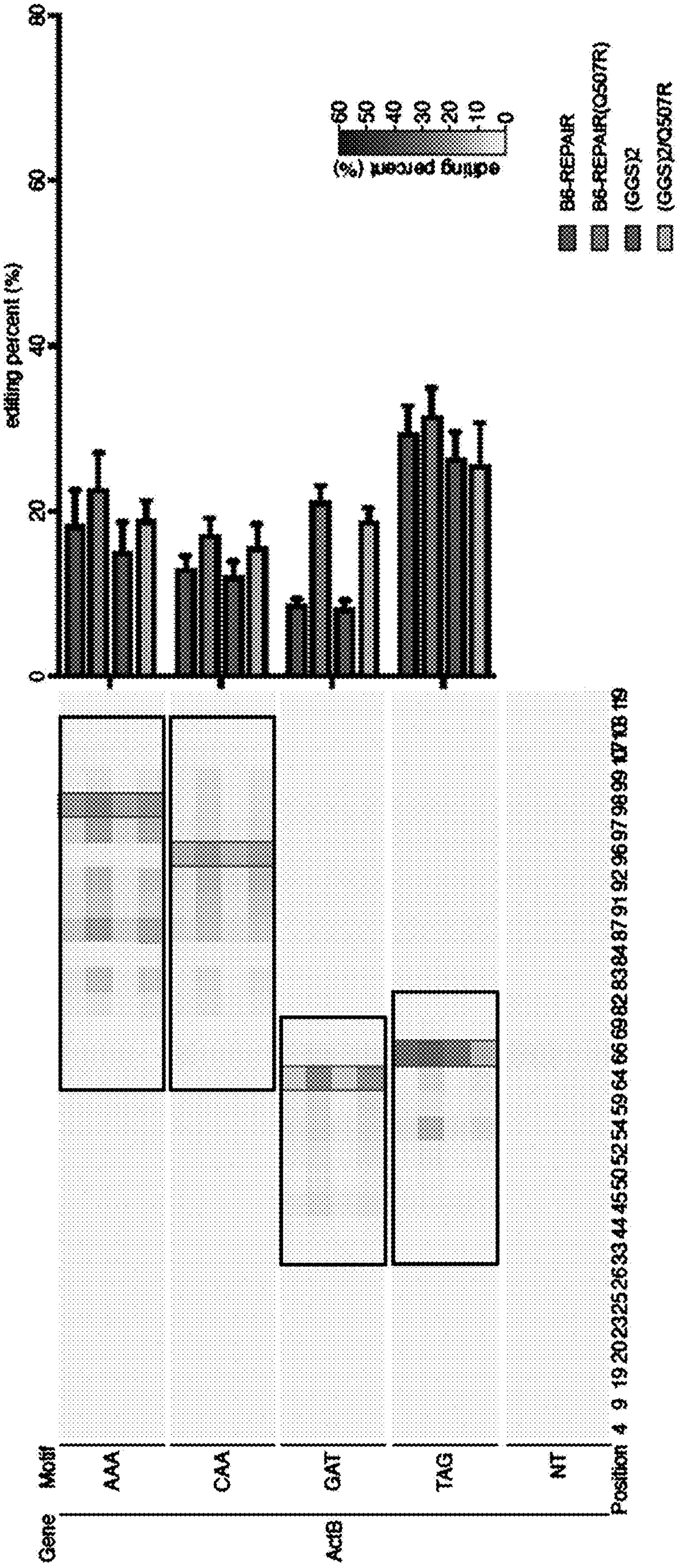
FIG. 37 shows test results of endogenous genes targets with (GGS)2/Q507R.
Figure 37B:
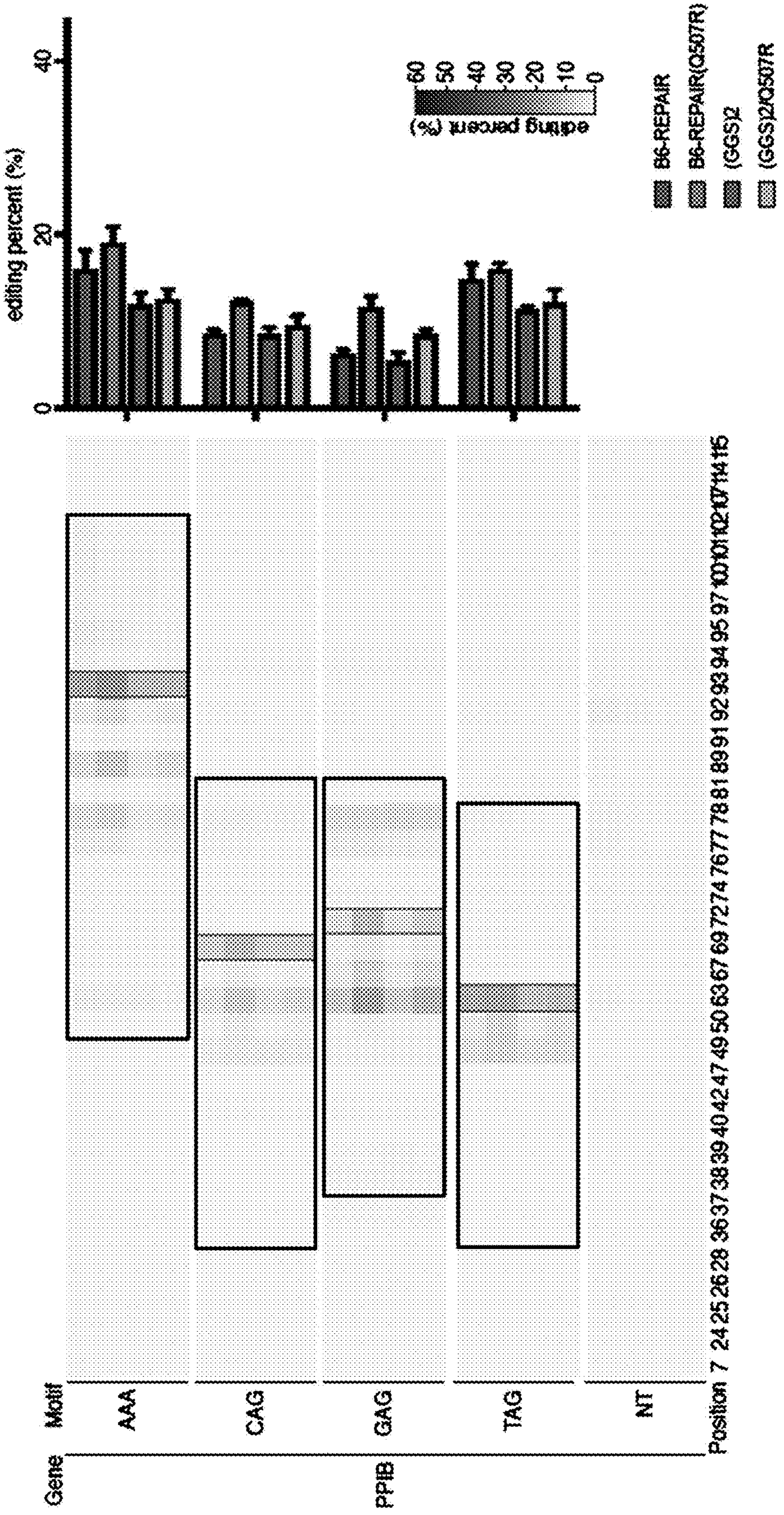
Figure 38:
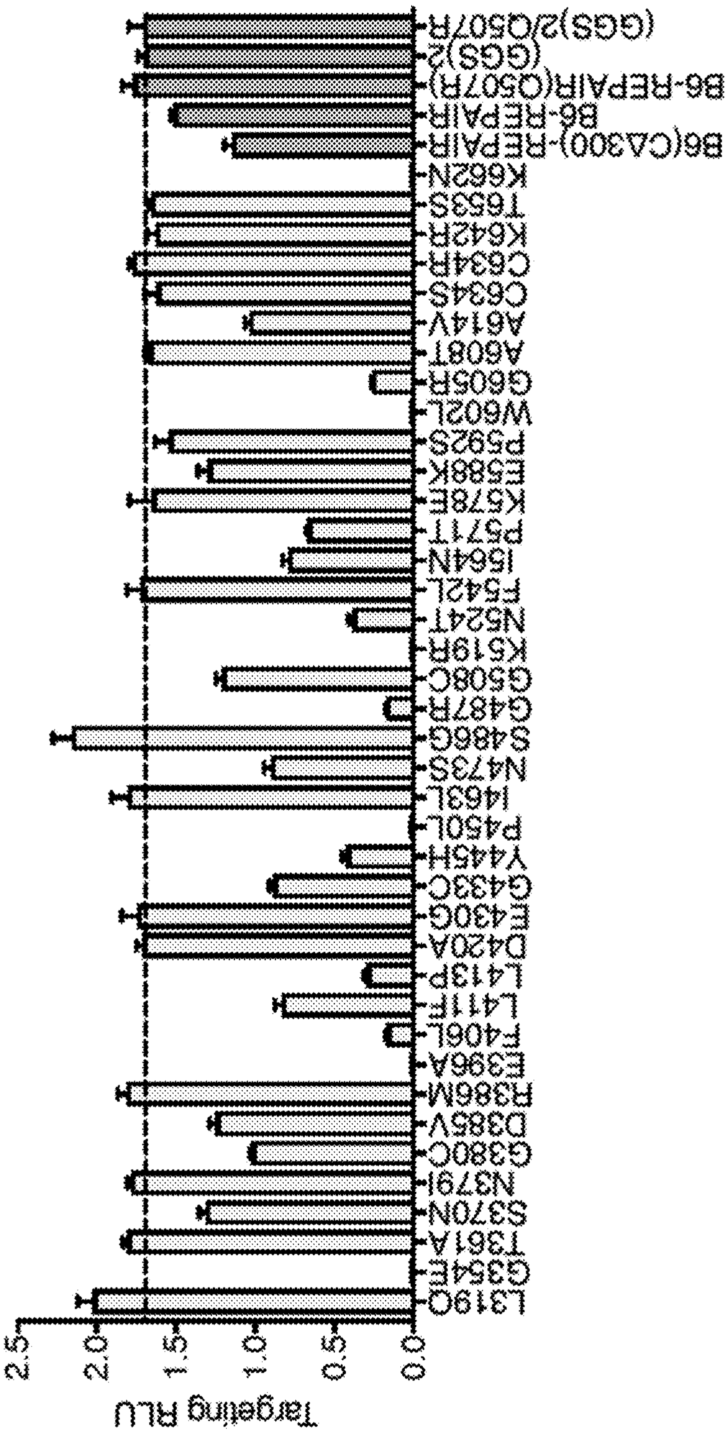
FIG. 38 and FIG. 39 show eGFP screening of mutations on (GGS)2/Q507R.
Figure 39:
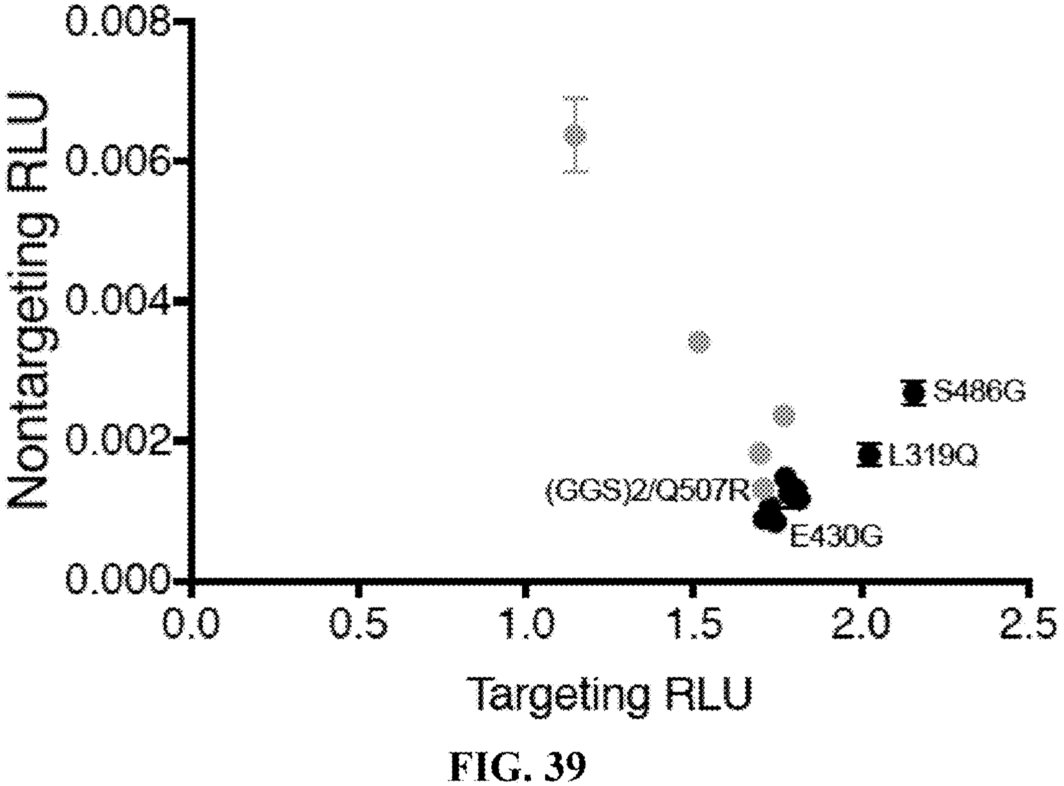

Quantification of off-targets was performed (FIG. 35). Off-target edits were tested (FIG. 36). Endogenous genes targeted with (GGS)2/Q507R were tested (FIG. 37). The eGFP screening of mutations on (GGS)2/Q507R was performed (FIGS. 38 and 39).

Figure 40A:
FIG. 40A shows constructs with Cas13b truncation.
Figure 40B:
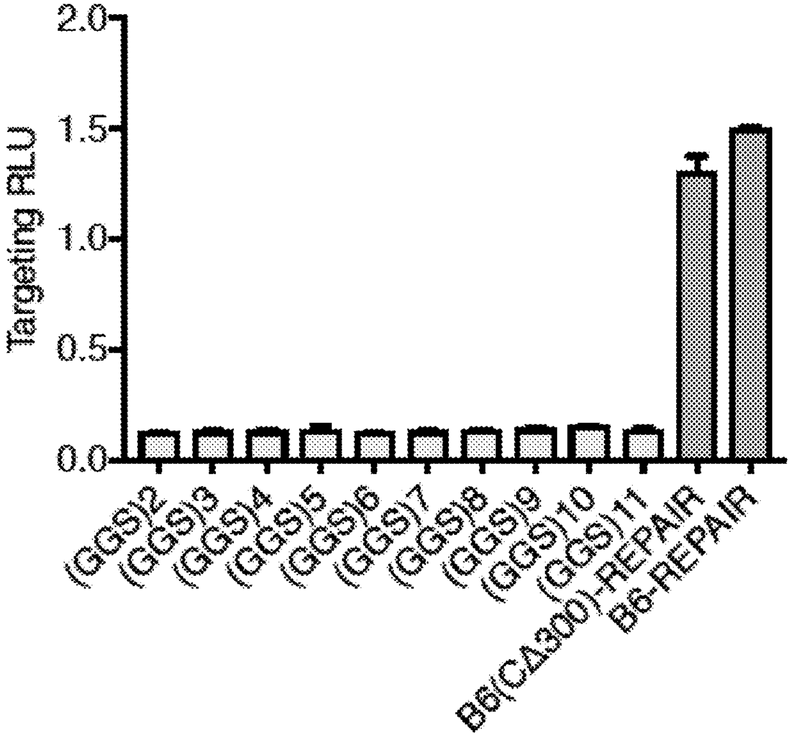
FIG. 40B shows test results of the constructs.
Figure 42A:
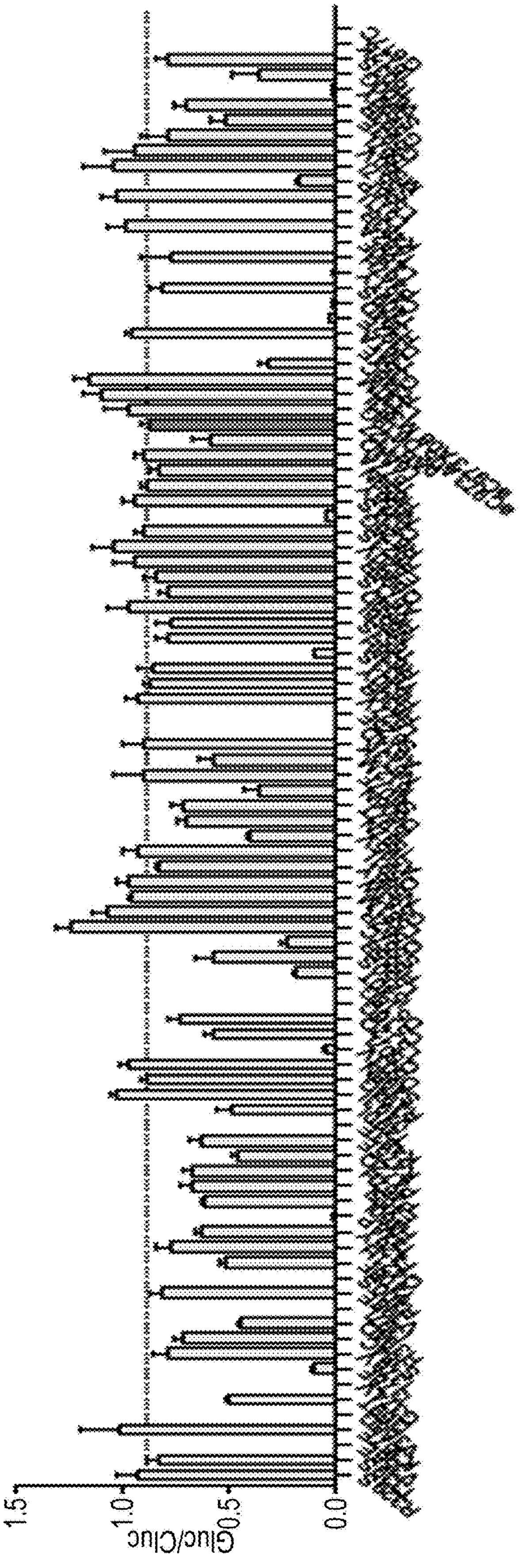
FIGS. 42A-42E show validation tests on RESCUEv10.
Figure 42B:
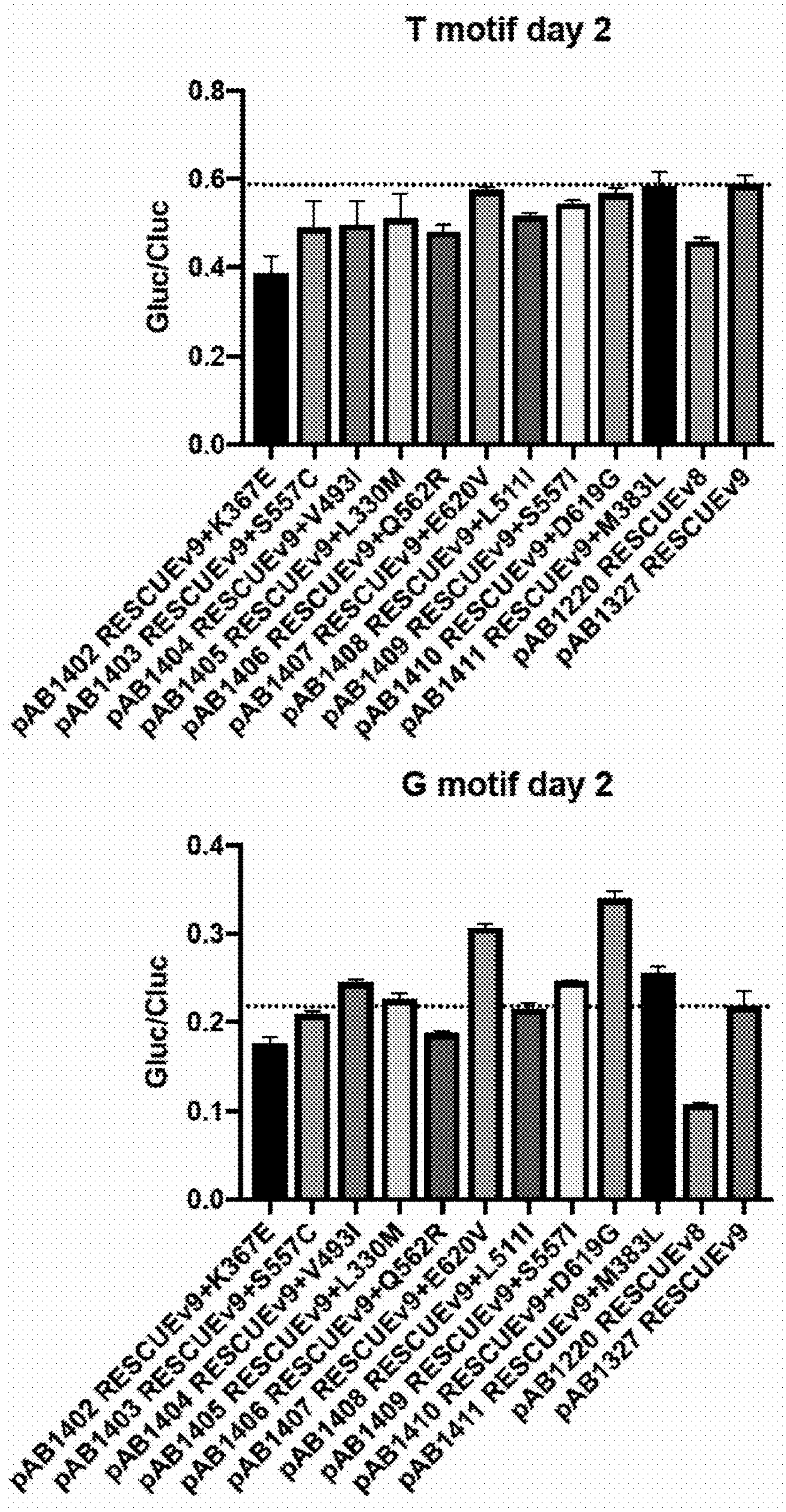
Figure 42C:
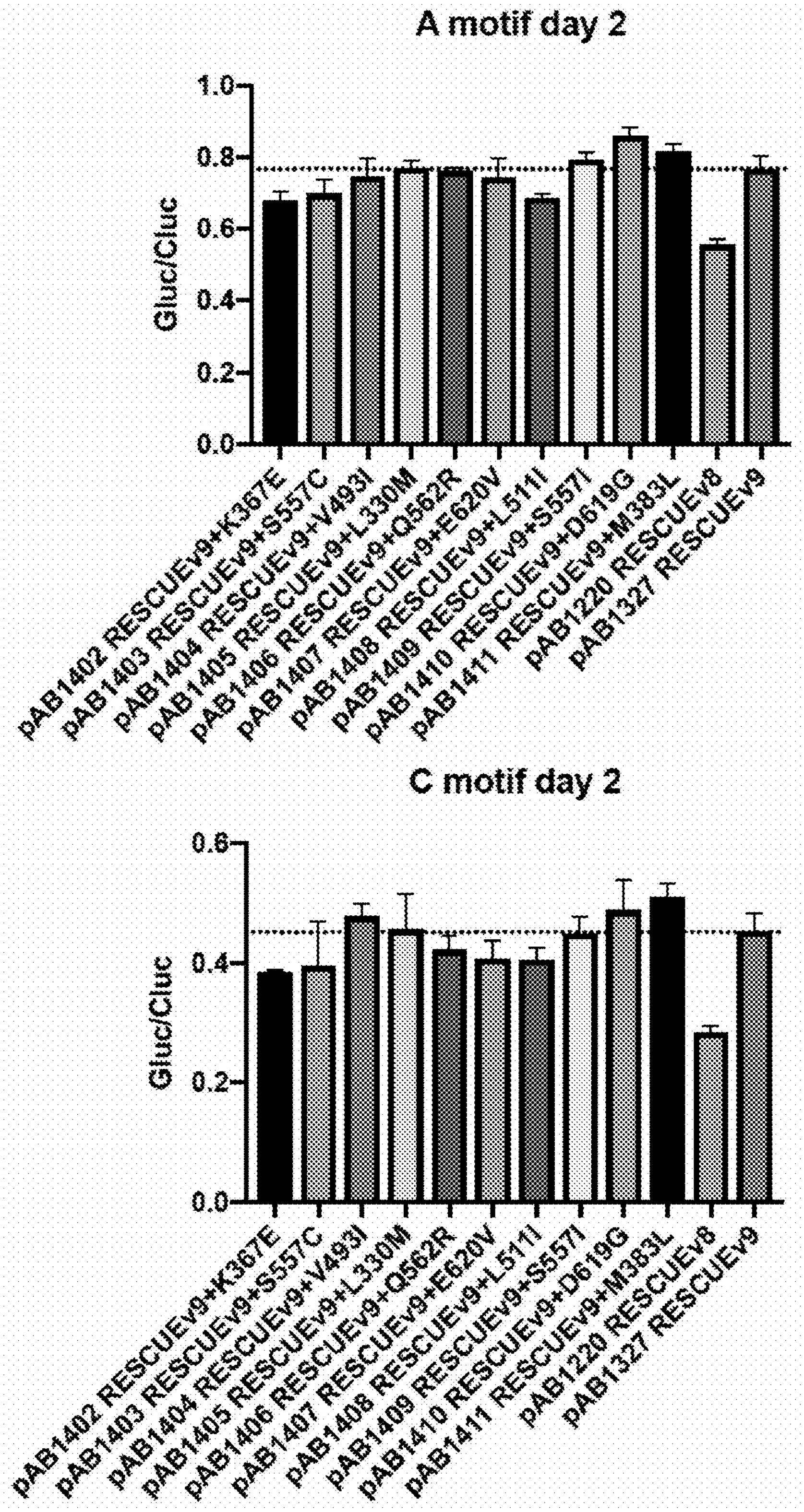
Figure 42D:
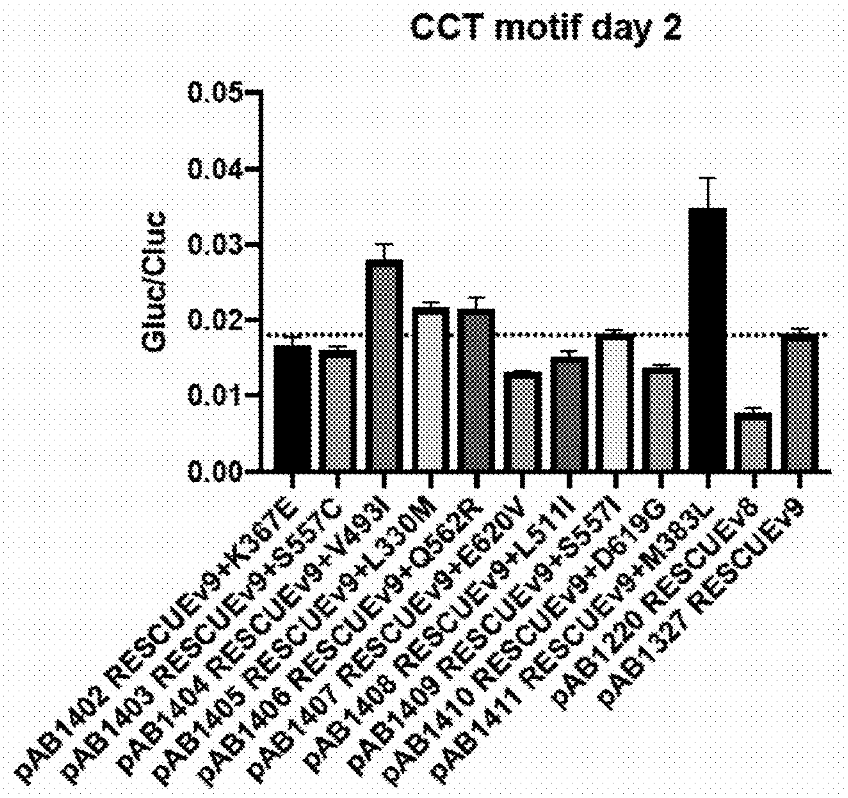
Figure 42E:
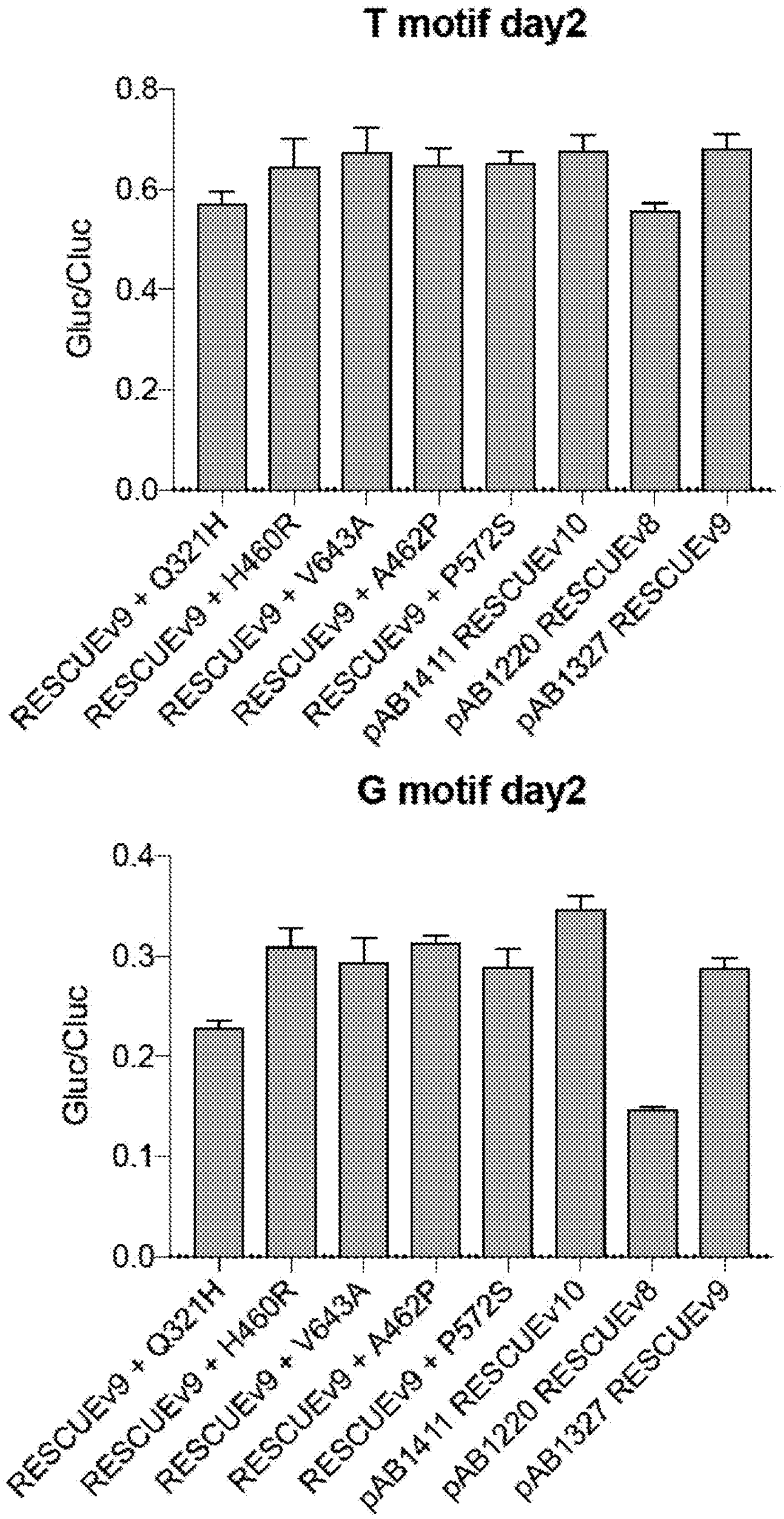
Figure 42F:
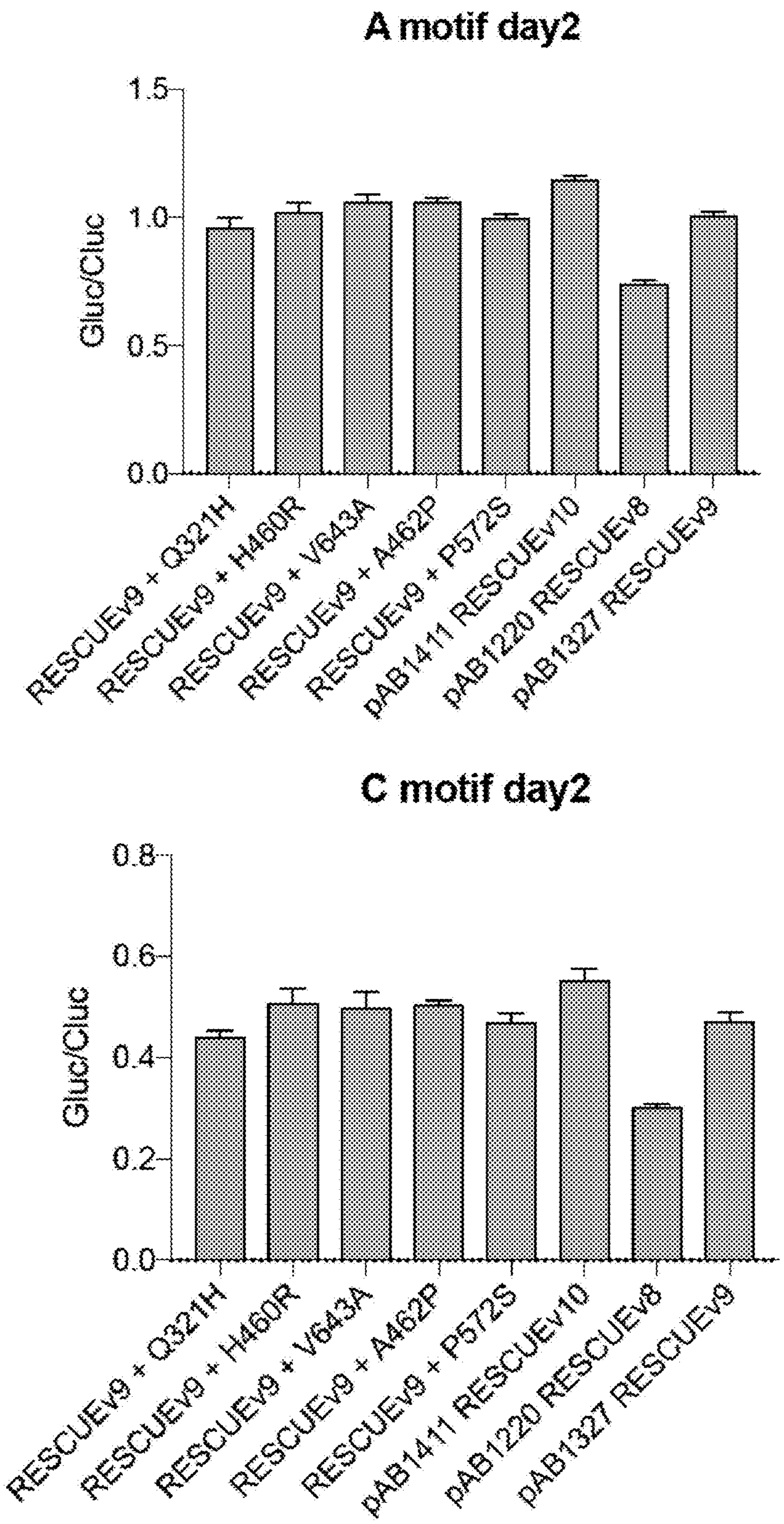
Figure 42G:
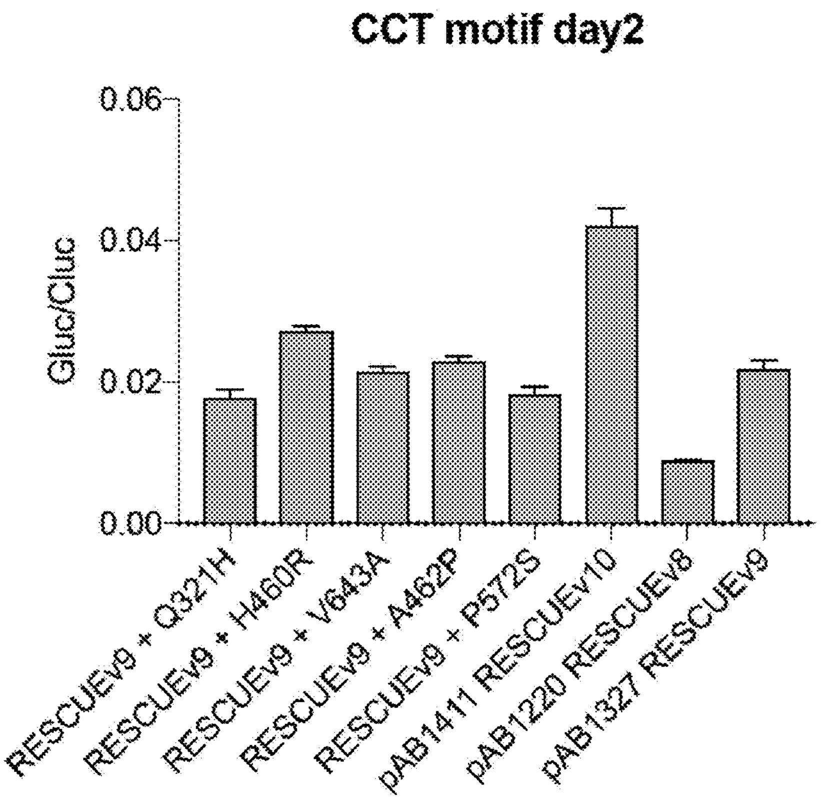
Figure 42H:
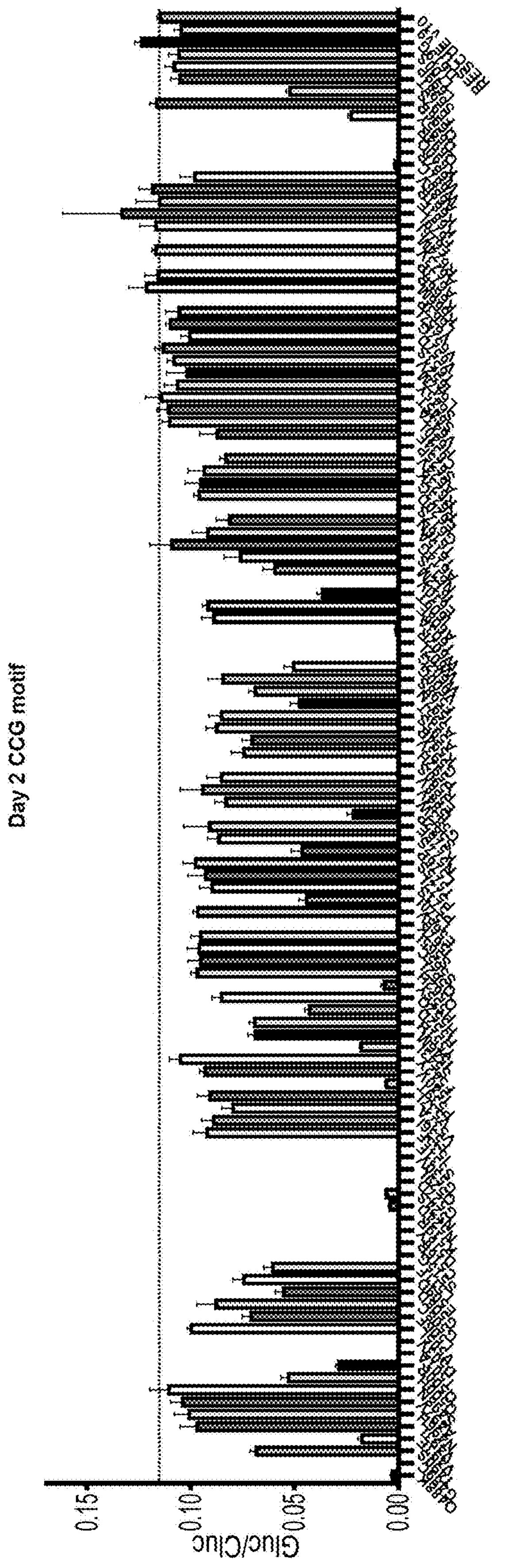
Figure 42I:
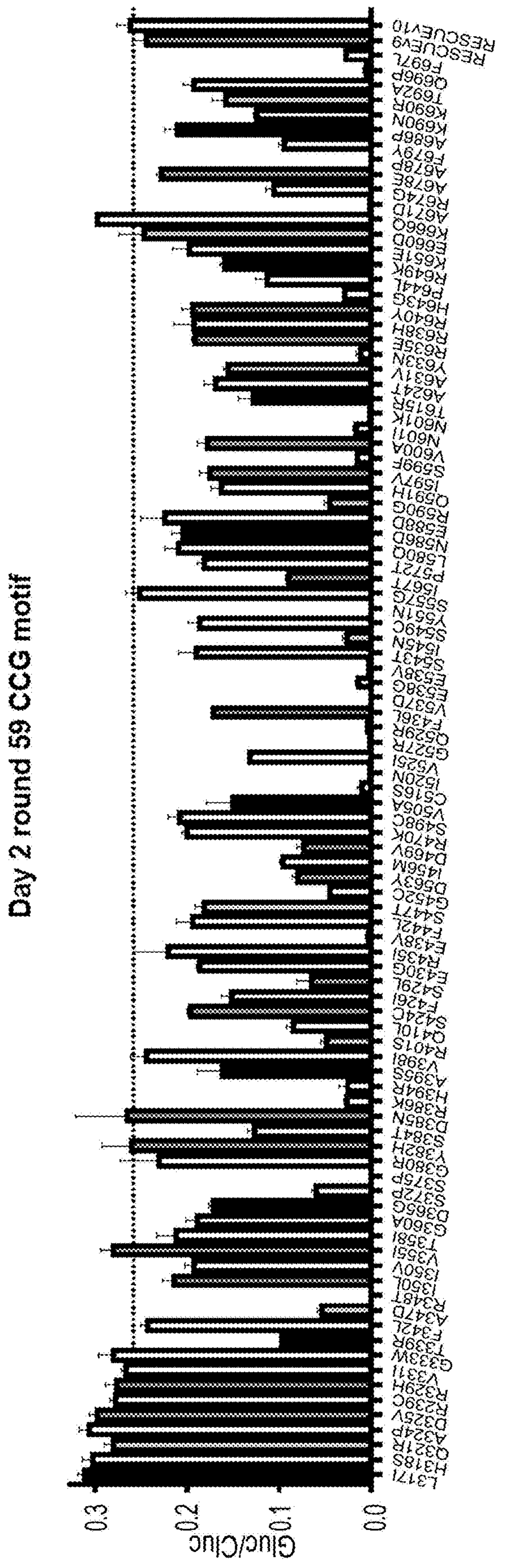
Figure 42J:
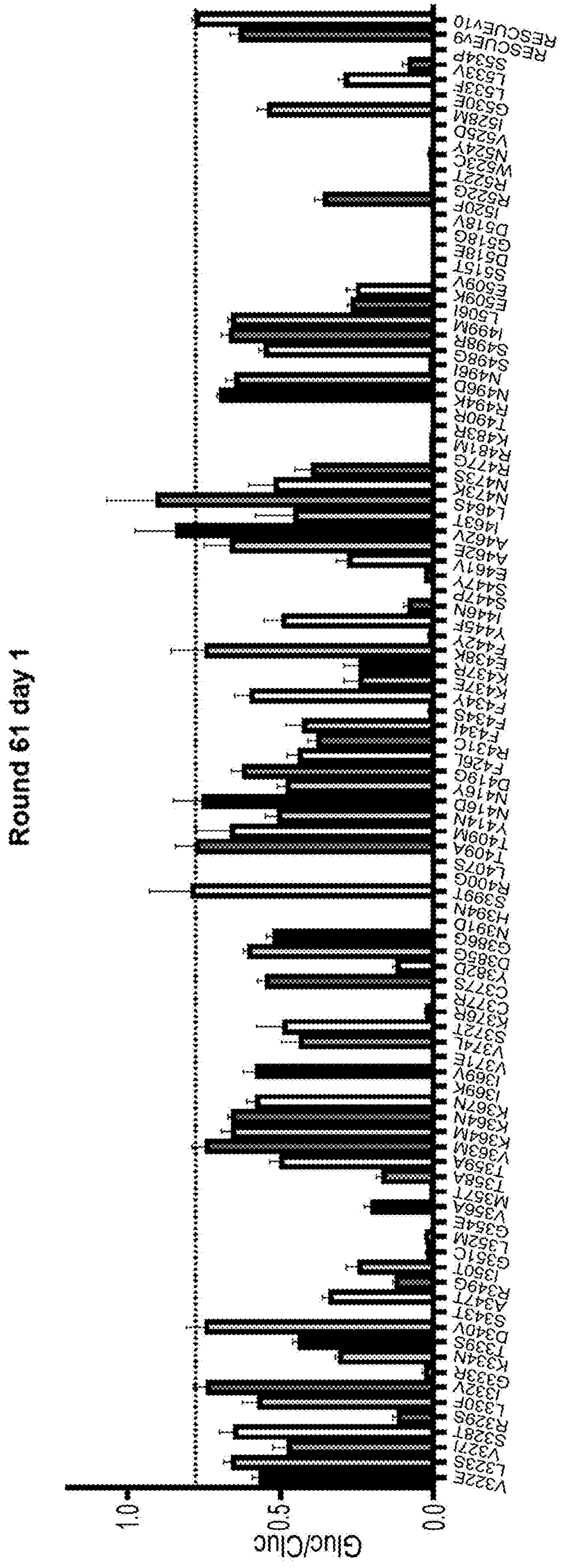

Constructs with dCas13b that was Cas13b truncation were generated (FIG. 40A) and tested (FIG. 401B). The constructs also had an N-terminal tag (NES/NLS). Multiplexed on/off-target guides were generated for screening (FIG. 41).

Example 7

Mutations in ADAR affecting ADAR activity were screened using yeast screening. The screen was performed in multiple rounds. Each round of screening yielded a set of candidate mutations. The candidate mutations were then validated in mammalian cells. The top-performing mutations were added to the last version of mutations and re-screened. The mutations screened in 10 rounds are shown in the table below. The mutant identified in round n was designated as "RESCUE vn−1." As discussed herein RESCUE refer to mutations that convert adenosine deaminase activity to cytidine deaminase activity.

TABLE 13

| RESCUE Round | ADAR mutations | Plasmid |
|---|---|---|
| RESCUEv0 | E488Q | pAB0048 |
| RESCUEv1 | E488Q, V351G | pAB0359 |
| RESCUEv2 | E488Q, V351G, S486A | pAB1188 |
| RESCUEv3 | E488Q, V351G, S486A, T375S | pAB0642 |
| RESCUEv4 | E488Q, V351G, S486A, T375S, S370C, | pAB1072 |
| RESCUEv5 | E488Q, V351G, S486A, T375S, S370C, P462A | pAB1135 |
| RESCUEv6 | E488Q, V351G, S486A, T375S, S370C, P462A, N597I | pAB1146 |
| RESCUEv7 | E488Q, V351G, S486A, T375S, S370C, P462A, N597I, L332I | pAB1194 |
| RESCUEv8 | E488Q, V351G, S486A, T375S, S370C, P462A, N597I, L332I, I398V | pAB1220 |
| RESCUEv9 | E488Q, V351G, S486A, T375S, S370C, P462A, N597I, L332I, I398V, K350I | pAB1327 |
| RESCUEv10 | E488Q, V351G, S486A, T375S, S370C, P462A, N597I, L332I, I398V, K350I, M383L | pAB1411 |

Figure 43A:
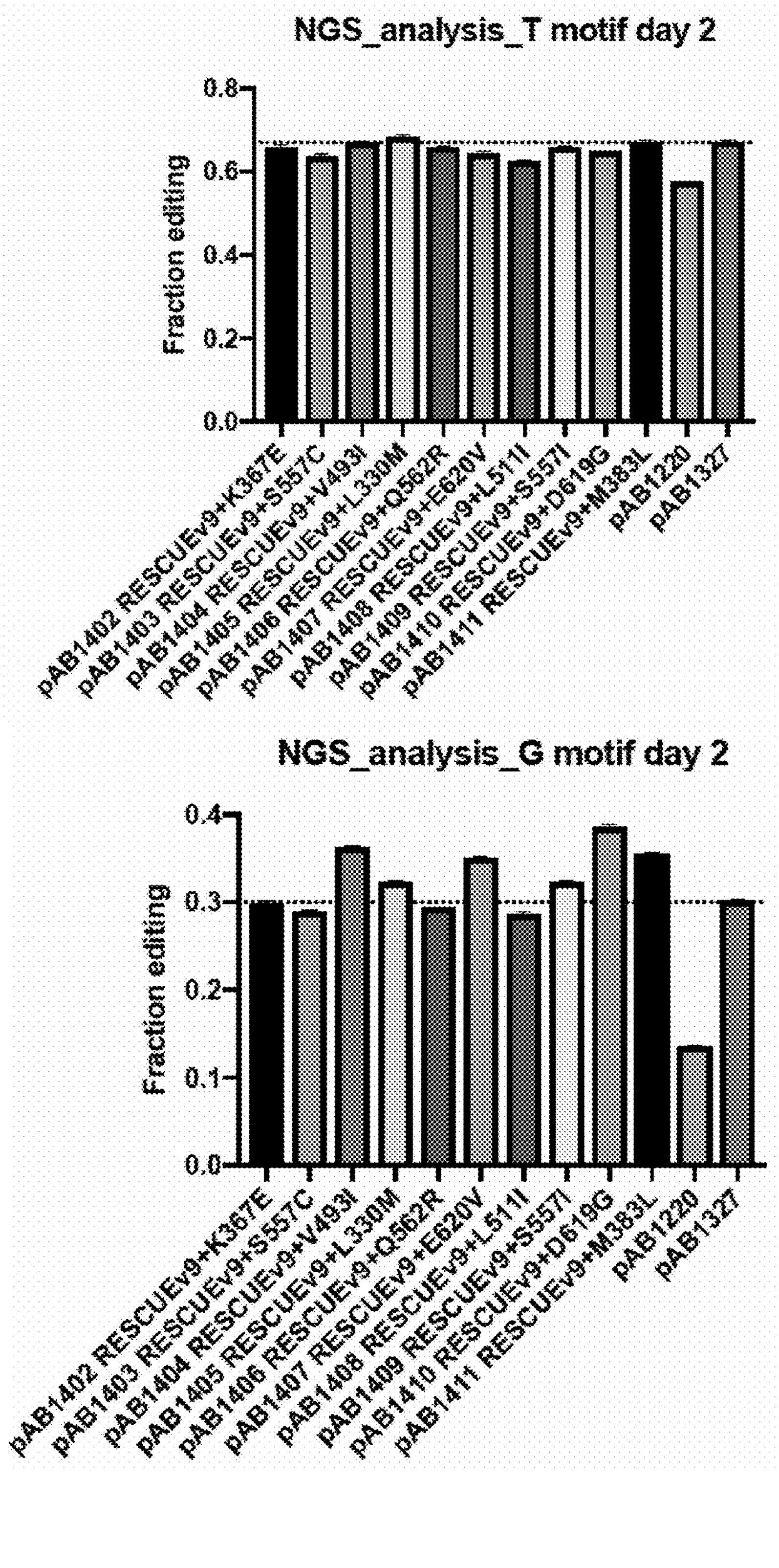
FIG. 43 shows NGS analysis of RESCUEv10.
Figure 43B:
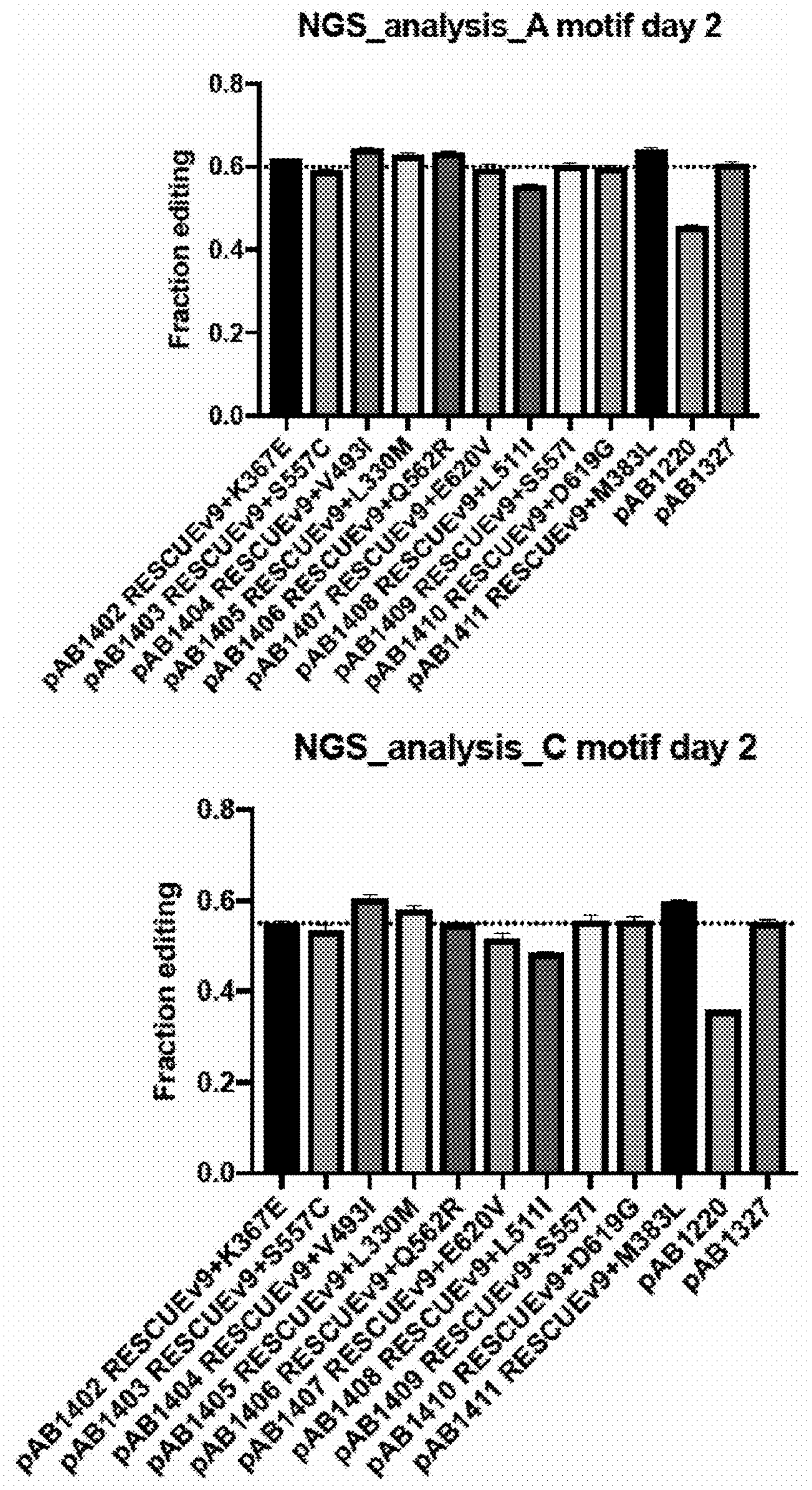
Figure 43C:
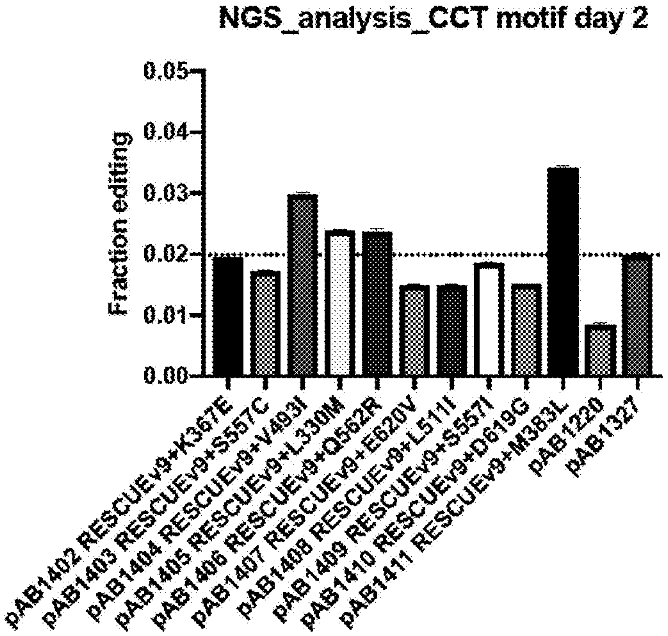
Figure 44:
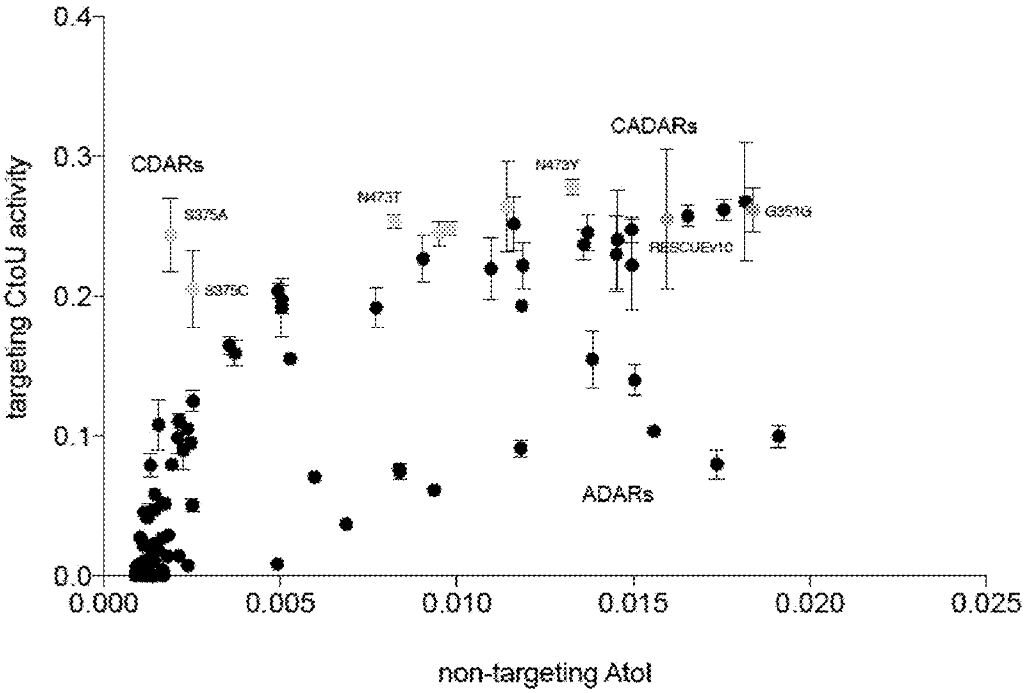
FIG. 44 shows identified mutations that improve specificity.
Figure 45A:
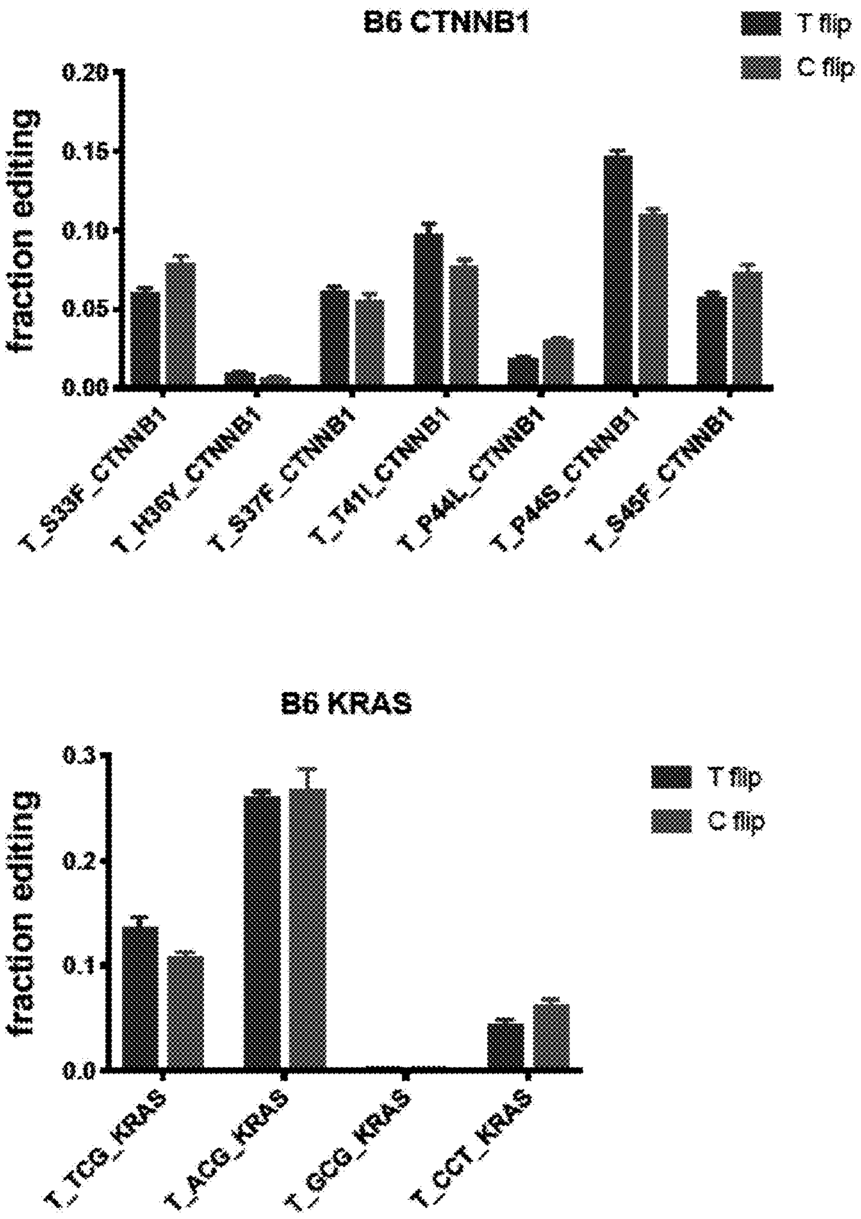
FIG. 45 shows effects of RESCUE on endogenous targeting (C-flips and T-flips) results.
Figure 45B:
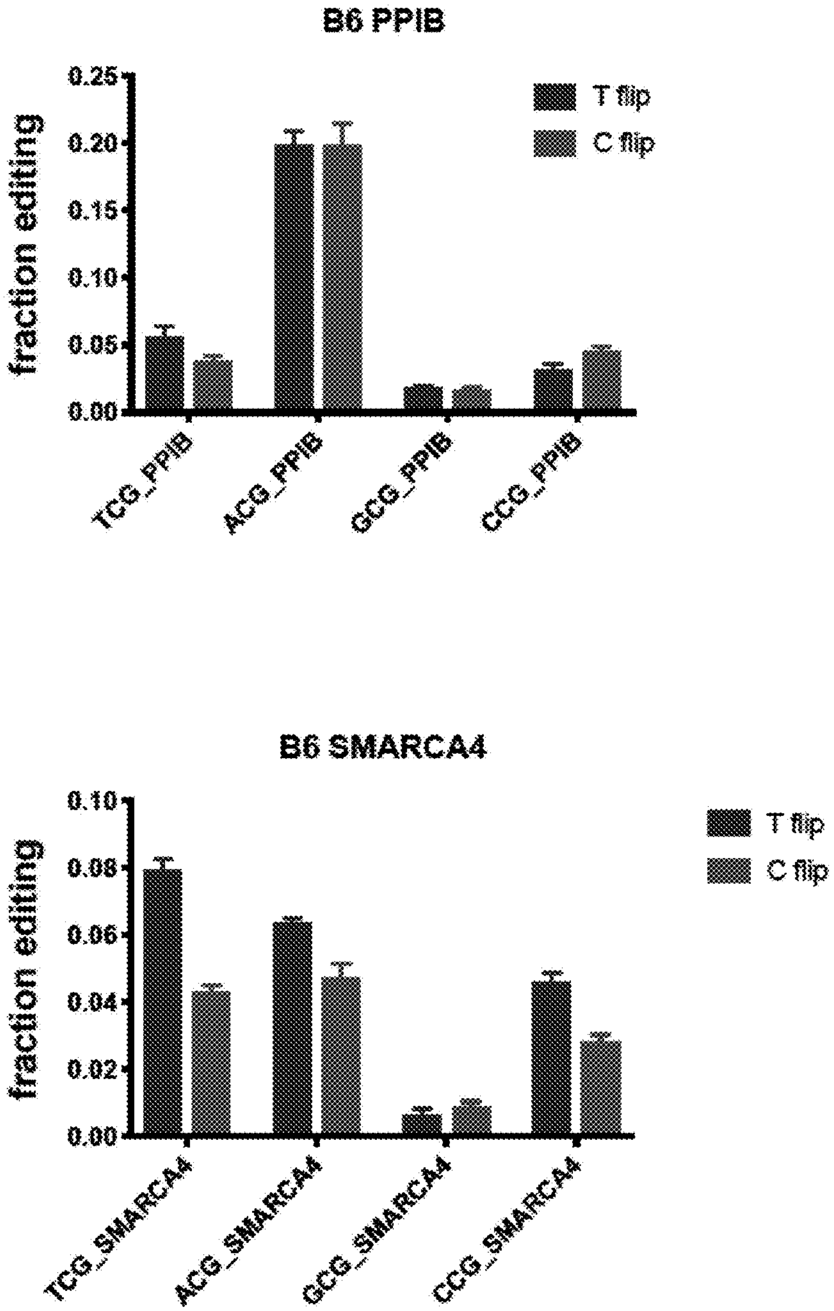
Figure 45C:
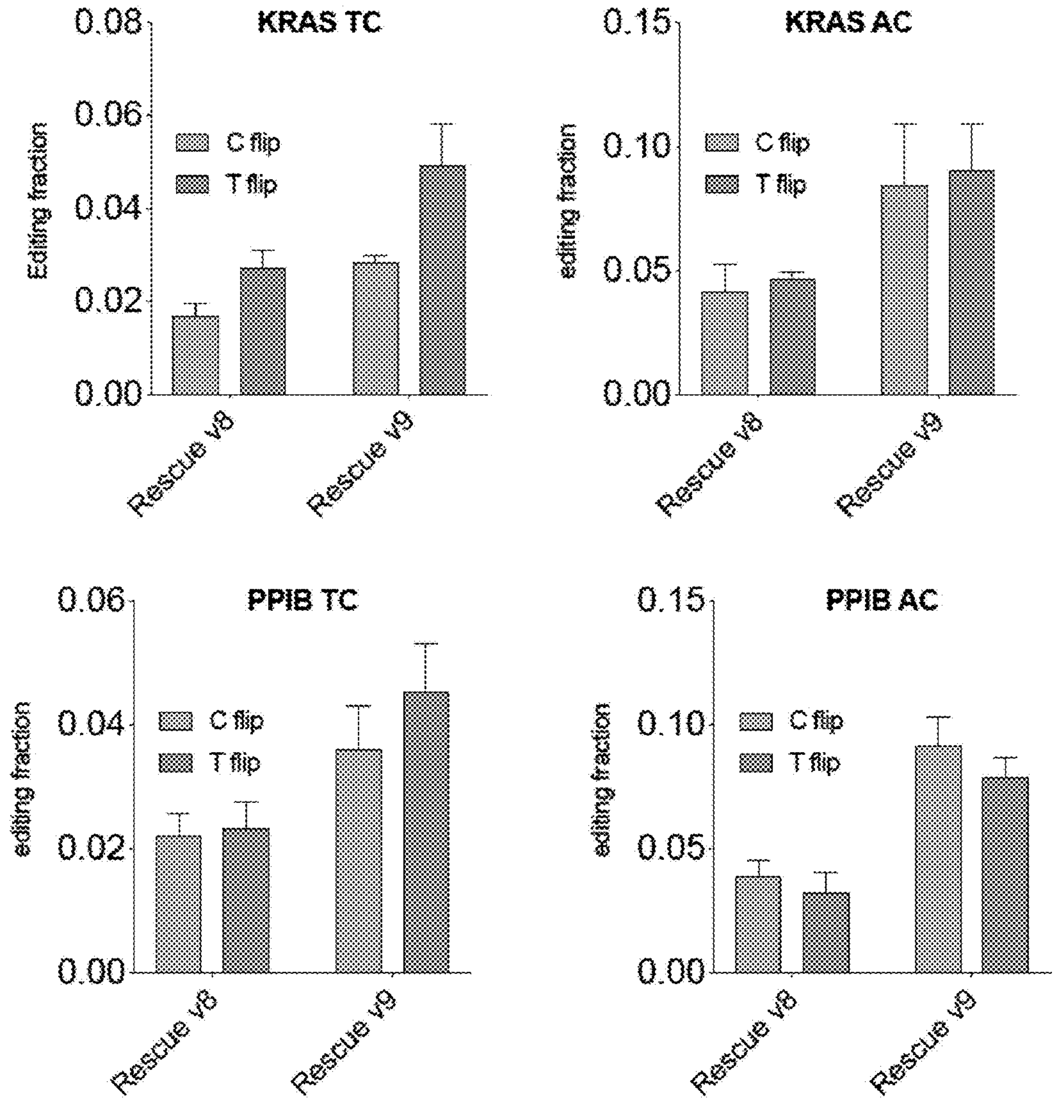

Multiple rounds of validation of RESCUEv10 were performed (FIGS. 42A-42E). RESCUEv10 was analyzed by next generation sequencing (NGS) (FIG. 43). Mutations that improve specificity were identified (FIG. 44). Effects of RESCUE on endogenous targeting (C-flips and T-flips) were tested (FIG. 45).

Figure 46A:
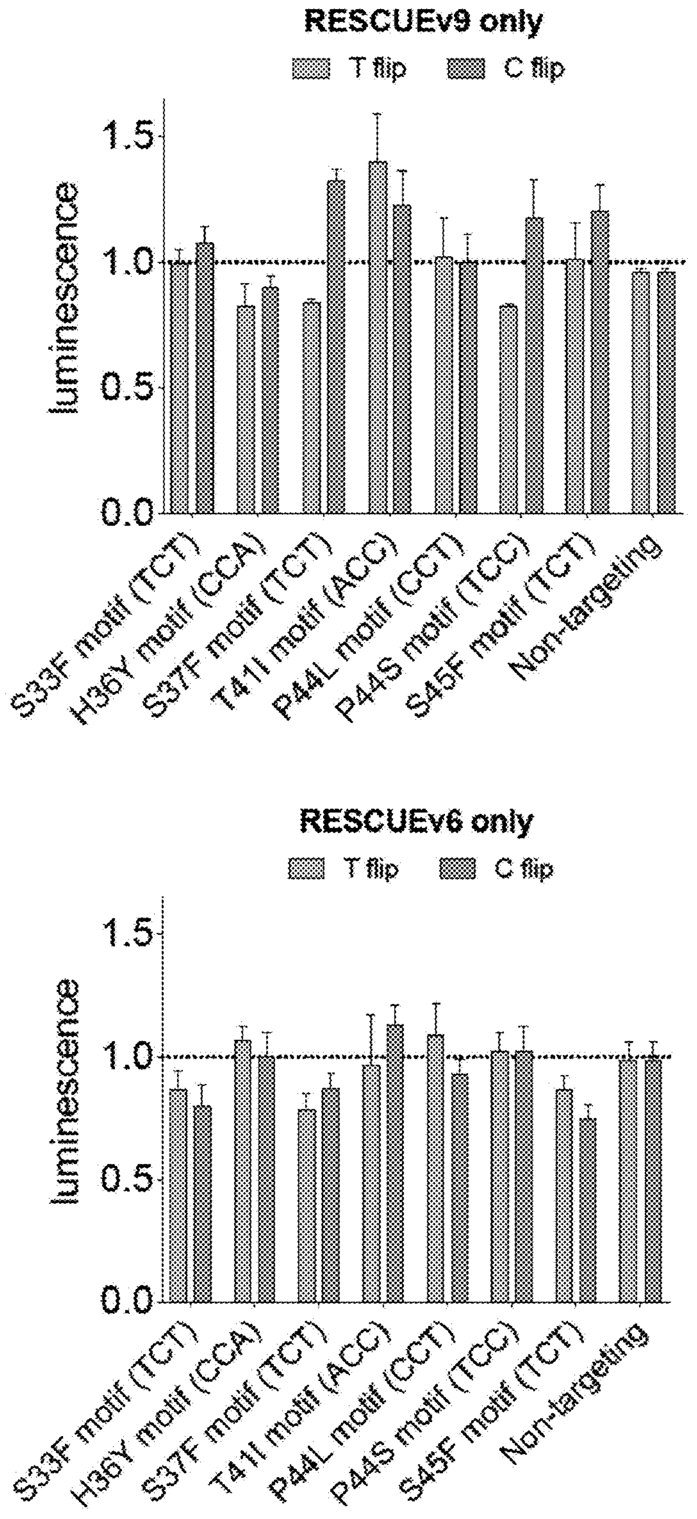
FIG. 46 shows targeting β-catenin using RESCUE v6 and v9.
Figure 46B:
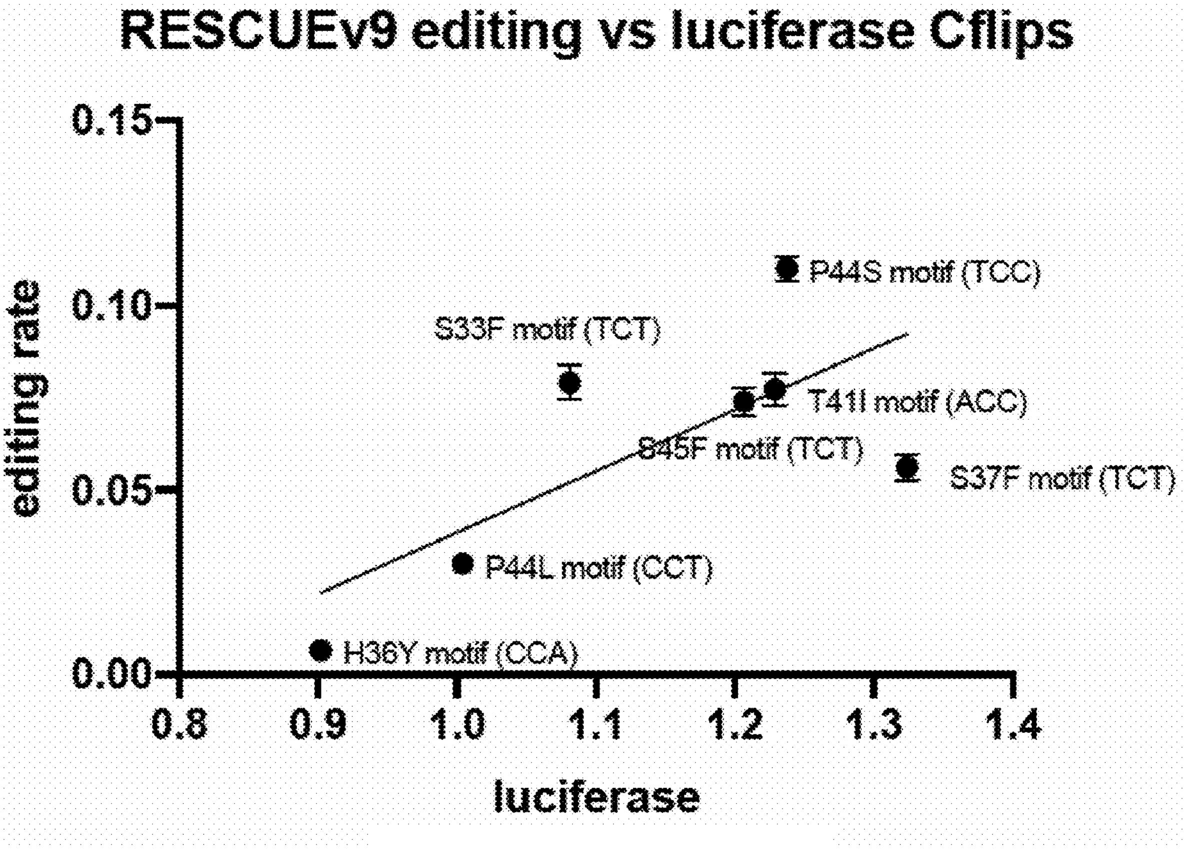
Figure 47:
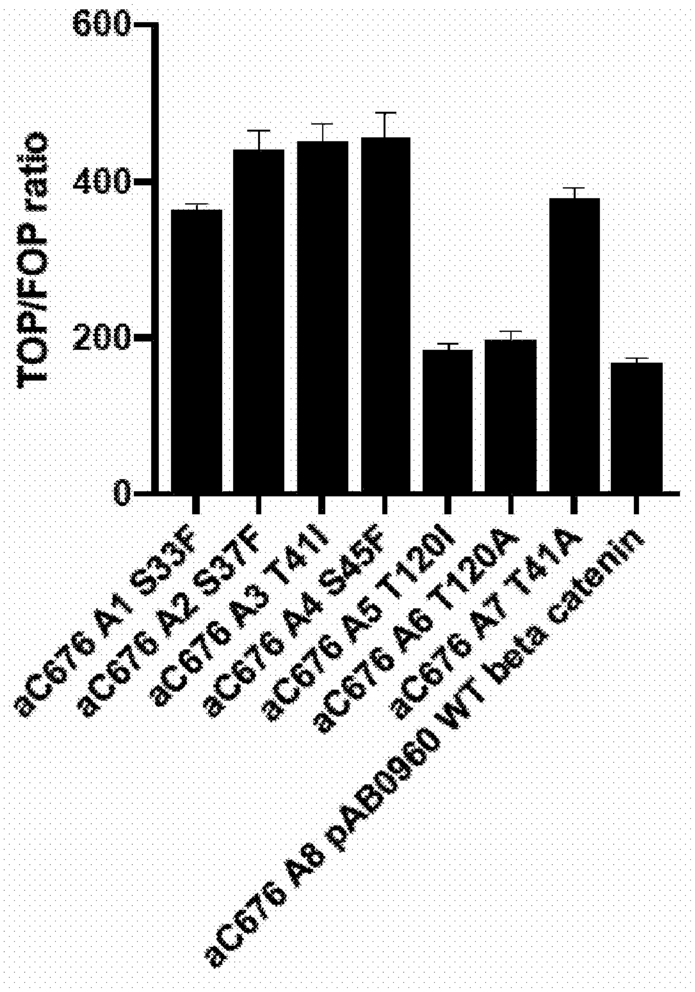
FIG. 47 shows new β-catenin secreted Gluc/Cluc reporter.
Figure 48:
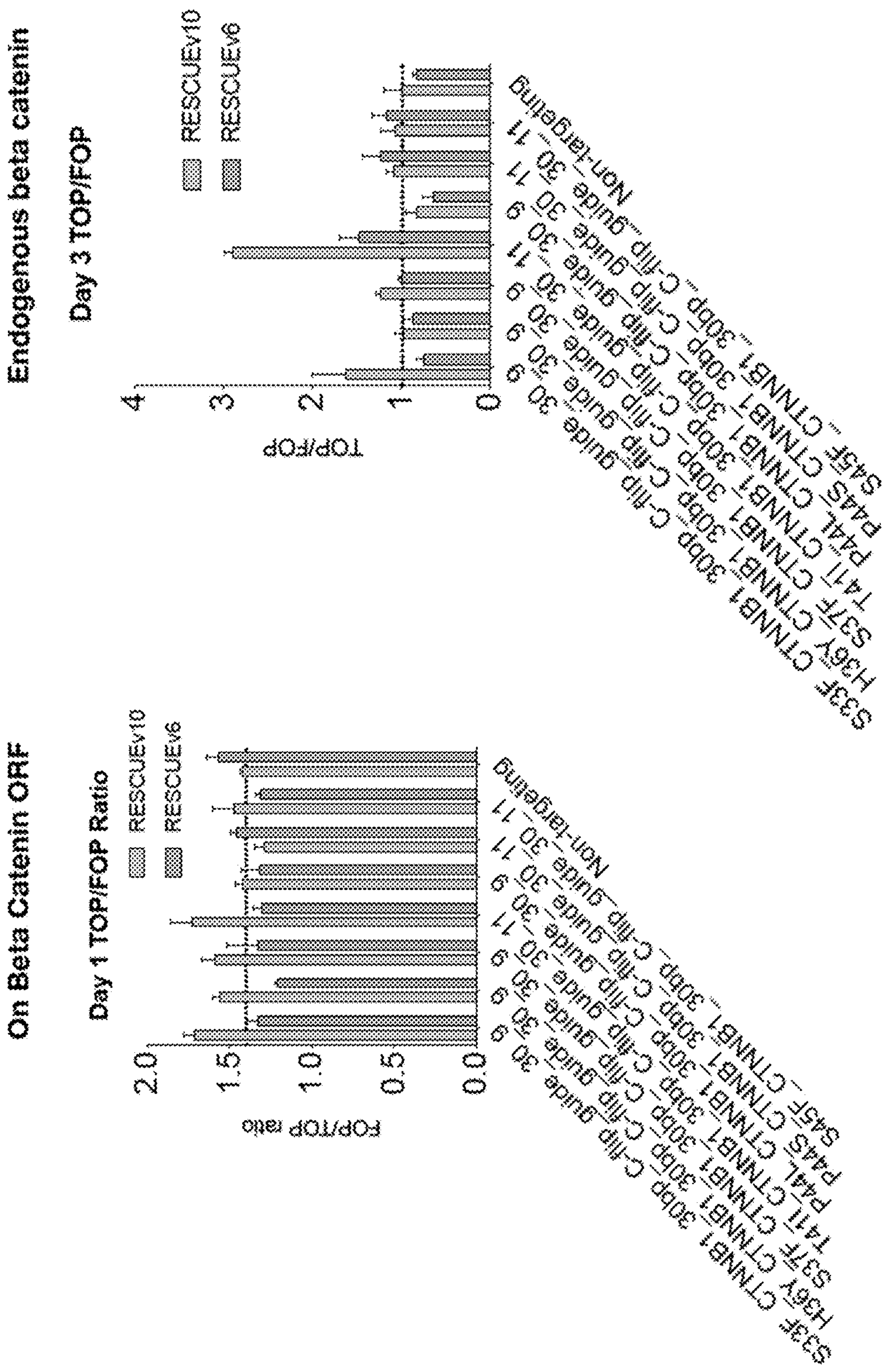
FIG. 48 shows results of targeting β-catenin by RESCUEv10.

RESCUEs were used for targeting β-catenin. FIG. 46 shows targeting β-catenin using RESCUE v6 and v9. FIG. 47 shows new β-catenin secreted Gluc/Clue reporter. FIG. 48 shows results of targeting β-catenin by RESCUEv10.

Figure 49:
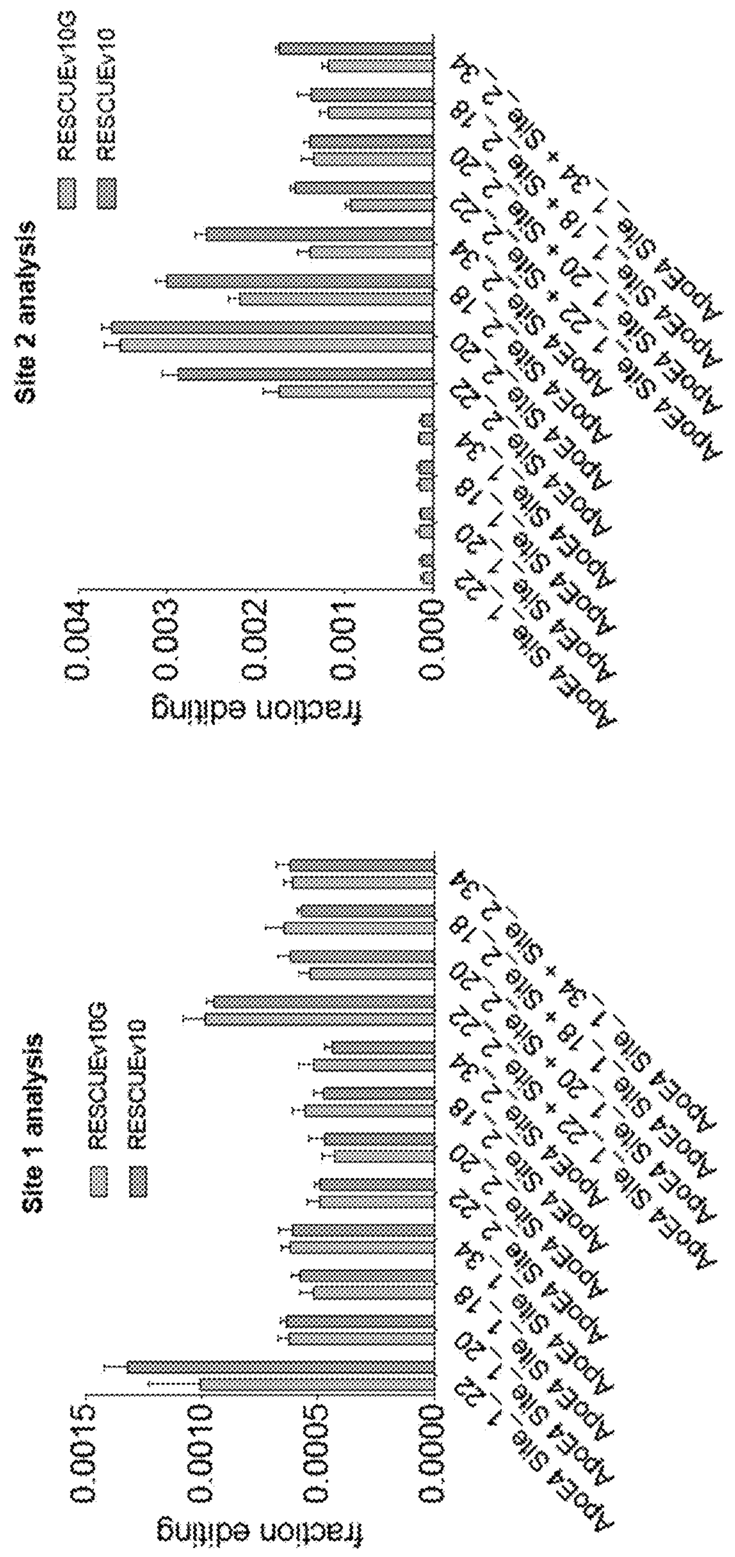
FIG. 49 shows targeting ApoE4 by RESCUEv10.

RESCUE may also be used for targeting other genes. FIG. 49 shows targeting ApoE4 by RESCUEv10.

Example 8

This example shows based editing β-catenin to increase stability of β-catenin using RESCUE to improve proliferation and survival of HUVECs in a nutrient deficient medium.

HUVECs are grown in a nutrient rich medium. Cells are transformed with adenovirus containing RESCUE constructs. The RESCUE targets β-catenin and generate S37A mutation. The transformed cells are passed at low confluence into a nutrient deficient medium. Cell proliferation and survival rate are measured using a cell-counting kit.

Example 9

This example shows based editing serine protease PCSK9 in HepG2 cells. The base editing modulates low density lipoprotein (LDL) cholesterol update in HepG2 cells by inducing patient-derived mutations on PCSK9.

Figure 50:
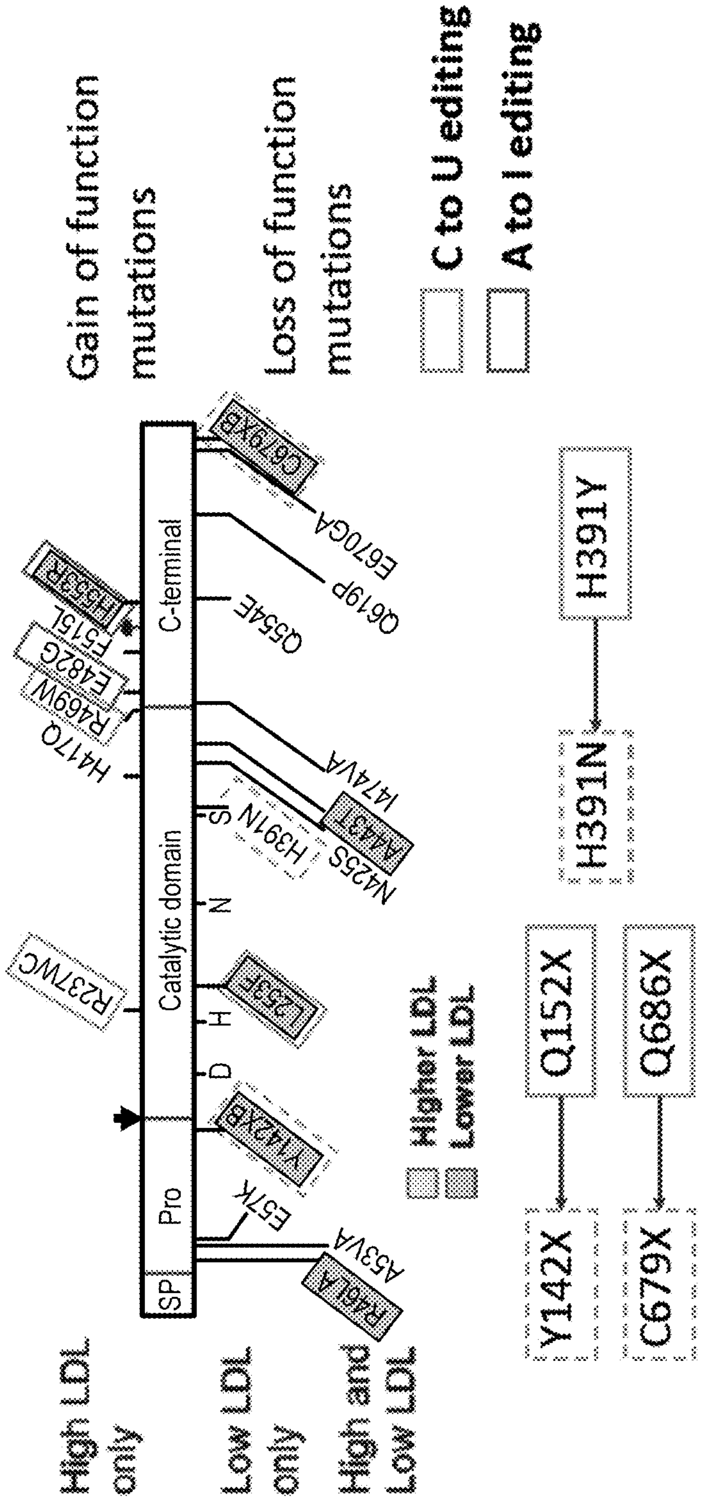
FIG. 50 shows exemplary mutations in PCSK9 that can be generated using RESCUE.

A GFP expression construct is transfected to HepG2 using various transfection reagents. The optimal transfection reagent resulting the best GFP expression is selected for transfecting RESCUE constructs. RESCUE constructs are transfected using 30 bp guides with target site at 5' 5, 7, 9, 11. One or more mutations in PCSK9 are generated by RESCUE. Exemplary mutations are shown in FIG. 50.

RT-PCR and sequencing are performed to identify the best-performing guides. Cytosolic LDL are fluorescently labeled and cellular update of cytosolic LDL is measured by cell imaging. PCSK9 secretion is monitored using ELISA and/or immunoprecipitation.

Example 10

This example lists information and data related to Cas13b-t. The respective sizes of Cas13b-t1, Cas13b-t2, and Cas13b-t3 are listed in Table 14.

TABLE 14

| Naming Key | Size |
|---|---|
| Cas13b-t1 | 804 aa |
| Cas13b-t2 | 802 aa |
| Cas13b-t3 | 775 aa |

Amino acid sequences of Cas13b-t1, Cas13b-t2, and Cas13b-t3 are shown below:

```
Cas13b-t1
                                   (SEQ ID NO: 272)
mndkstwqlklhrivrwsflrrqrvgcdishhfdfilvrrsgiknmefen
ikktsnkevysiegyegekkwcfaivlnraqtnleenpklfeqtltrfek
imkqdwfneetkkliyekeeenkvkeeiqiaaserlknlrnyfshylhap
dclifnrndtiriimekayeksrfeakkkqqedisiefpelfeeedkits
agvvffvsffierrflnrlmgyvqgfrktegeynitrqvfskyclkdsys
vqaqdhdavmfrdilgylsrvpteiyqhikltrkrsqdqlserktdkfil
falkyledyglkdladytacfarskikrenedtketdgnkhkfhrekpvv
eihfdkekqdqfyikrnnvilkaqkkggqsnyfrmgvyelkylvllsllg
kaeeaiqridryisslkkqlpyldkisneeiqksinflprfvrsrlgllq
vddekrlktrleyvkakwtdkkegsrklelhrkgrdilryinercdrpls
rkeynnilkfivnkdfagfyneleelkrtrrldkniiqklsghttlnalh
ervcdlvlqelgslqsenlkeyiglipkeekevtfrekvdrileqpvvyk
gflryeffkedkksfarlveeaiktkwsdfdiplgeeyynipsldrfdrt
nkklyetlamdrlclmmarqyylrlneklaekaqhiywkkedgreviifk
fqnpkeqkksfsirfsildytkmyvmddpeflsrlweyfipkeakeidyh
khyarafdkytnlqkegidailklegriierrkikpaknyiefqeimnrs
gynndqqvalkrvrnallhynlnferehlkrfygyvkregiekkwsliv

Cas13b-t2
                                   (SEQ ID NO: 273)
mqvenikkgssqgmysiegyegakkwcfaivlnraqtnlqgnpklfeetl
trferirkedwfdqetkkliyakqeqneveeeiqkaadeklrdlrnyfsh
yfhtpdcliftqndpvriimekayekarfeqakkeqedisiefgelfeen
gritsagvvffasffaerrflnrlmgyvqgftrtegeykitrdvfstycl
rdsysvktpdhdavmfrdilgylsrvpsesyqrikesqmrsetqlserkt
dkfilfalnyledygledladytacfartrikreqdentdgkeqkphrkk
prveihferaegdpfyikhnnvilrtqkkgaqtyifrmgvyelkylvlls
llgkgaeavkridryvhslrnqlphiekksteeiegyvrflprfvrshlg
llgvddekkikarvdyvkakwlekkeksrelqlhrkgrdilryinercer
plnideynrilellvtkhldgfyreleelkktrridknivenlsrhksvn
alhekvcdlvvqeleslgreelkeyvglipkeekevsfeektdrvvkqpv
iykgflrneffresrksfarlveeavrekgevydvplggeyyeivsldtf
dkdnkrlyetlamdrlllmiarqyhlslnkelakraqqiewkkedgeevi
iftlknpaqpeqscsvrfslrdytklyvmddaeflarlcdyflpkdeeqi
dyhrlytqgmnrytnlqregieailelekktigpeqprppknyipfseim
```

-continued dksayneddqkalrrvrnallhhnlnfaradfkrfcgimkregiekrwsl av

Cas13b-t3

Figure 54A:
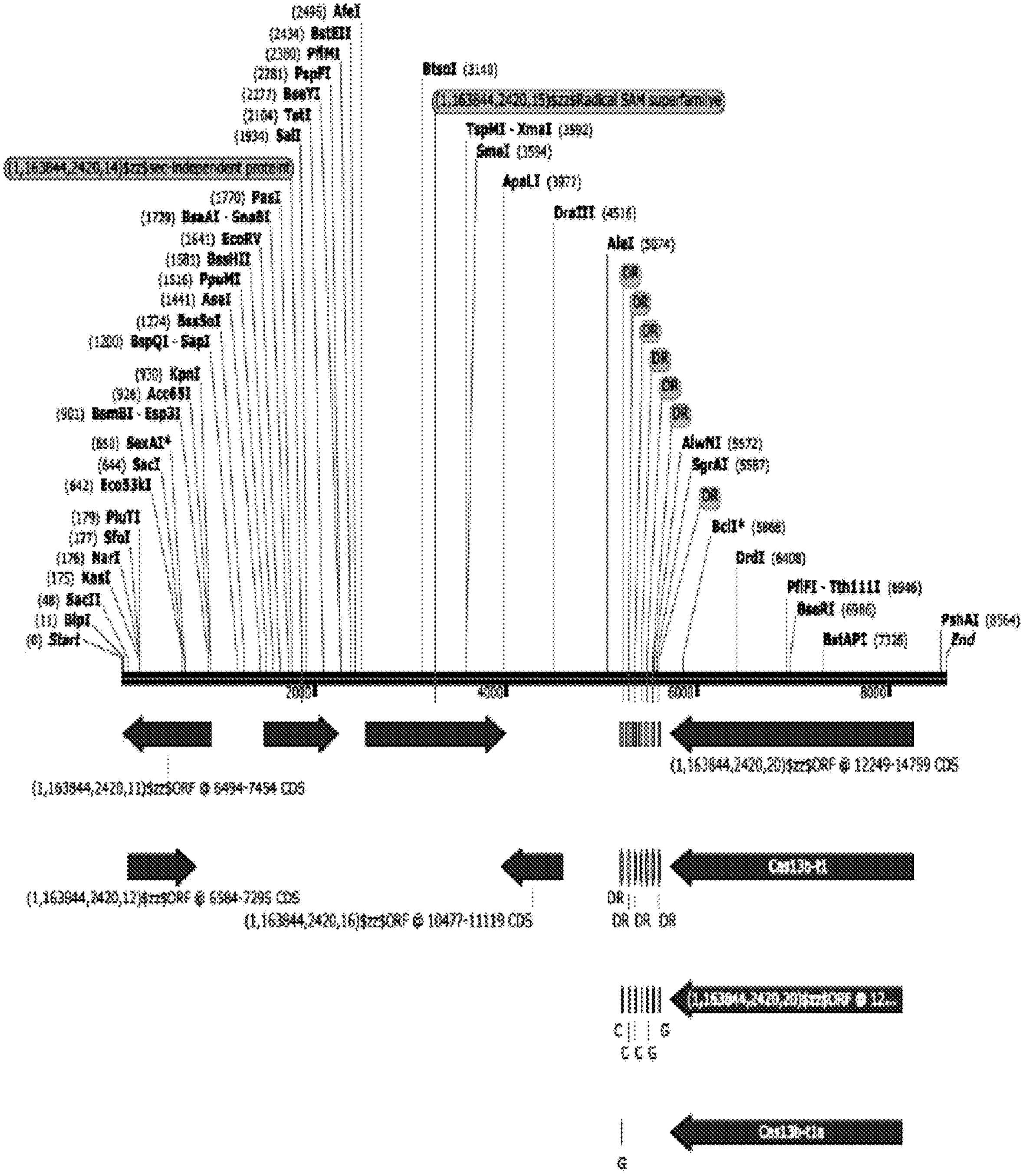
FIGS. 54A-54C show loci of Cas13b-t1, Cas13b-t2, and Cas13b-t3.
Figure 54B:
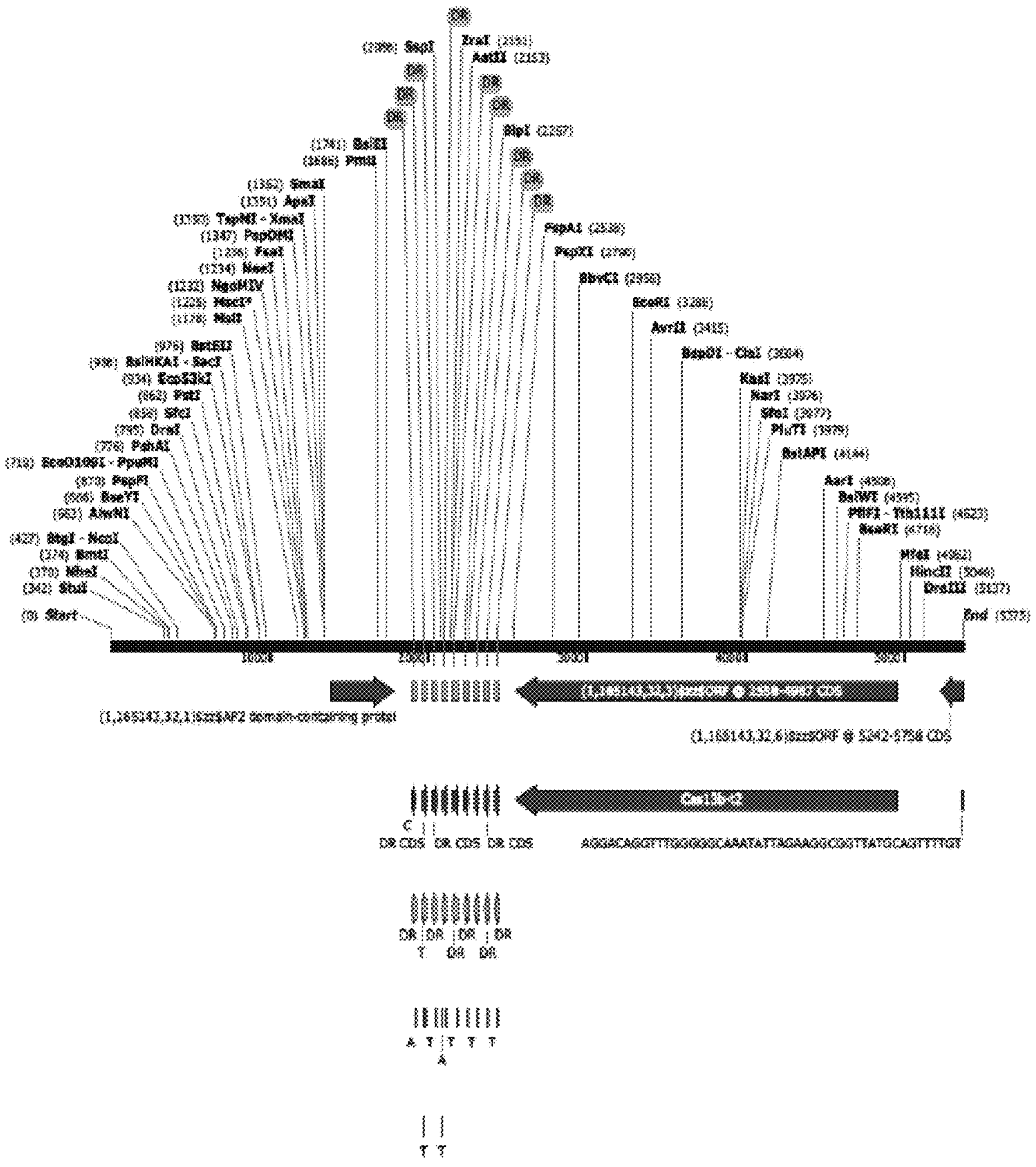
Figure 54C:
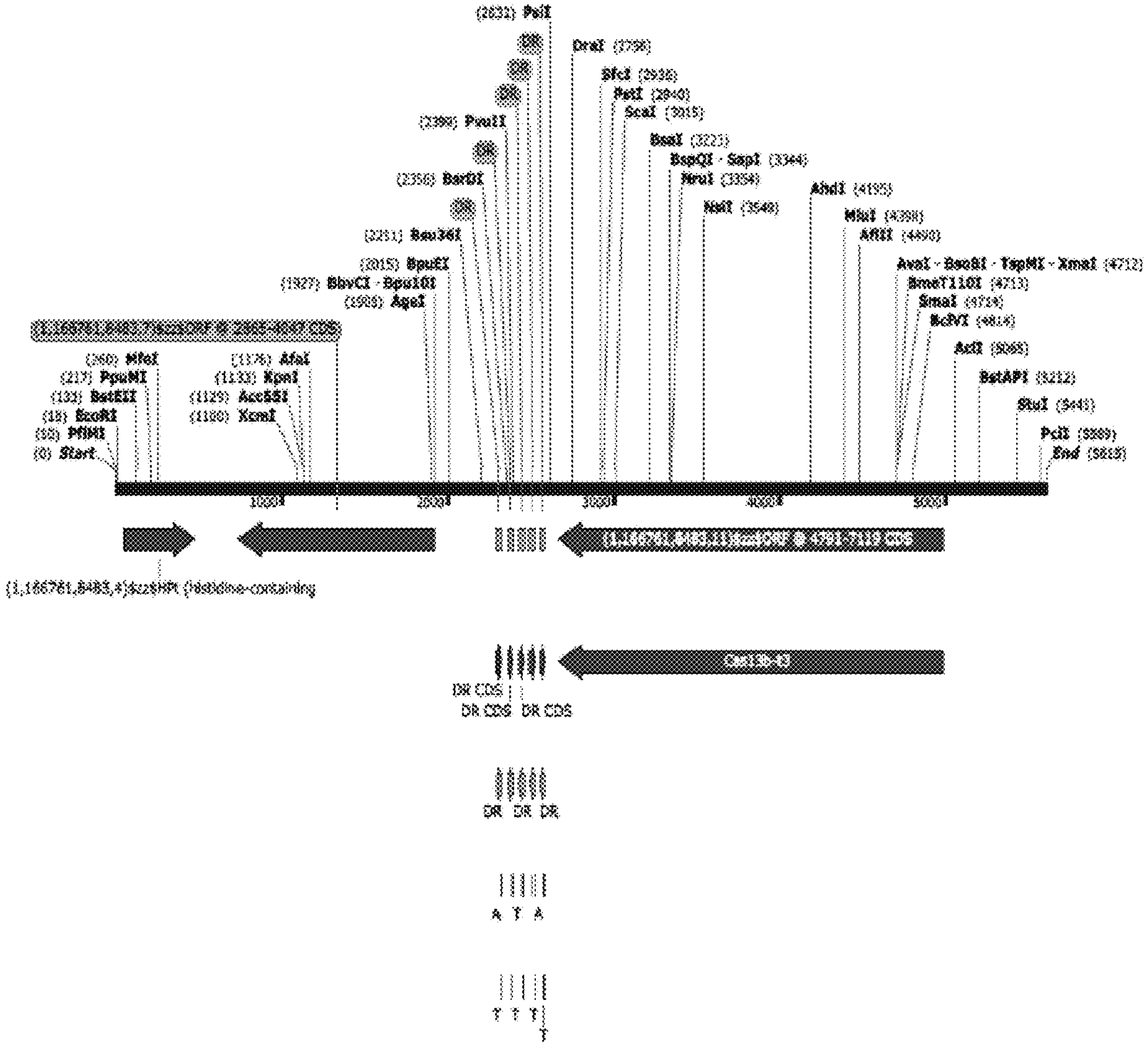

(SEQ ID NO: 274)

maqvskqtskkrelsideyqgarkwcftiafnkalvnrdkndglfvesll rhekyskhdwydedtralikcstqaanakaealrnyfshyrhspgcltft aedelrtimerayeraifecrrreteviiefpslfegdrittagvvffvs ffverrvldrlygaysglkknegqykltrkalsmyclkdsrftkawdkry llfrdilaqlgripaeayeyyhgeqgdkkrandnegtnpkrhkdkfiefa lhyleaqhseicfgrrhivreeagagdehkkhrtkgkvvvdfskkdedqs yyisknnvivridknagprsyrmglnelkylvllslqgkgddaiaklyry rqhvenildvvkvtdkdnhvflprfvleqhgigrkafkgridgrvkhvrg vwekkkaatnemtlhekardilqyvnenctrsfnpgeynrllvclvgkdv enfqaglkrlqlaeridgrvysifaqtstinemhqvvcdqilnrlcrigd qklydyvglgkkdeidykqkvawfkehisirrgflrkkfwydskkgfakl veehlesgggqrdvgldkkyyhidaigrfeganpalyetlardrlclmma qyflgsvrkelgnkivwsndsielpvegsvgneksivfsvsdygklyvld daeflgriceyfmphekgkiryhtvyekgfrayndlqkkcveavlafeek vvkakkmsekegahyidfreilaqtmckeaektavnkvrraffhhhlkfv idefglfsdvmkkygiekewkfpvk Loci of Cas13b-t1, Cas13b-t2, and Cas13b-t3 are shown in FIGS. 54A-54C. The sequences of the loci are shown below:

Cas13b-t1 locus (SEQ ID NO: 275)

agctgtcccgctgagatattaacaagcattaccgctaaattttccgcggactgttggttttcagcttcgtgaatgccaa caacaaaaggccctgtcgaaagcacaatttcggtggtgtcatagaaatccaggactttgccttcgagggttttattggtt gccttctttgctgtggcgccattttcaatcagaaagctgcgatagctttctgcgactgcctcggcatctttgggaccgga gcgtttgctcagaaatgccgtgatggtttcaccgttaagctggtatccggcagcgaagatgtcagtcaatccttcaaagc caaatgcacttgccagataaagataatgatcctgggaccaaattatcctttggcaggtgctcgatttcaggtatagcg gtatcatcgtgaacggccaggttcgtgggaattttccttgcgacttccgccattgccgcaaacagctcatccgattcggc gaagccgaccagctcgatataatattggccgtgcgcaagataaaacgcattactggttttgtatgcaaattgcatatccg gcaggttctcaacttcgggcctttttgcacgctgtaaaccgagaatgcgtttctggttctggccatatcaaagatatag agctccatcaccaggttttcatccgcctggcttacaaatctctgggtggacaattttataaaaccagcgtcgatataaag gggggccttgccgttaatcttttcgtaaagattttcggtggtgtagacttcaatttctgaaagcgttttgaatccgtaag gcagaagaaaagtcaggtctttcttttgttttggcatctgctttatgaataccccaacggcgataagtaagagaatcgct aataagcagatgcctataacagattcgagacgttttgcccggcttggtaccgaacccataaccaactccagtaatgacaa attacttgactttataaccgggctggattataattttttgccggtgttgctgtcaaccccaaatgctacaggtgaaaaagg cgaagatagatttctaacgaggttgacaaagcaggtcagggcgtgttataataggttgctaaagtaaaaaggagactgaa atgattgaatatgcacaatatttggggttttggacgccgggcccccttgaaattgctgttattgcgattgtcgctcttct gatattcggcagacggctgcctgaaatcgcccgcaacgtaggcaagagcctgactgaattcaagaaggggatcacgagg ccaaggagaccaaggacgaattggtggatgatgtccgggaagtcaaggatgatgtggtaagagaggcgaaggatgccgcc gggctgaatgaagaggatacaatgggctctgattgattattgataaaggggaactaatcactgagaacaattgtcaatca ttaatcaacaatcaatattgaagatccgcctgtggcggaatcaattttaagatgggcgatacaaagaagaaagaggacc tccttgattccactatgagtctgggcgaccaccttgaggaattgcggatgcggctgattcgcgcgctggtgggcctggcg ttagctatattatctgtctgatcttcggcaagctgctgatatcatttattcaaaaaccttacgttgctgtgatgggtga agaggctactctgaagacgcttgccccggcccaagggattaacagctacgtaaaaatagccttggtctcaggcttgatat tctcatcgccctgggtatctaccagttatggatgttcgtggctgcaggactctatcctaatgaaaaaagatatgtgtat gtagcagtaccttttttcggtggtattatttgttgccggagctttgtttttcatctttgtagtggcagaagtgtctcttgc tttcttaataaaggtcgacaggtggctcggactggaacccgactggactttcccgaagtatgtgacctttgtaaccaccc tgatgctggtatttggtgttgcgtttcagaccccgatagctattttctttttgaacaagacaggtctggtttcagtccag gcgttacggcggtcaagaaaatatgtactgctacttatcgttgtagtagcagctatggcgactccgcctgatgtggtttc tcaagtaacactggcgataccgttgtatgtgctgtttgaattaggcatactgctgagttactttgcagaactaaaaaaga -continued gaaagtcgaaaaacaaccagtgataagccgacaatccccagctttcccagtaccgactacttgtttctttcgggcctggt
ttttatttcgtcaatcgagcgactaagaaatcttcaaaggcgcttaaatccttccataccgtggcacagttaatggtttt
ggctttgttatctattacggtgtatccatagtcggtaacccgaatgccgagtttttcgggctcattttagacatttgcat
ctatgccgccggcagcgctgaaggtttttcggagctaattgagtattcagcataaatgttgaacggttttgccaatgcg
ggtactatgatgttgatgctaacgttgataaatacaaatgtgatggtccctcccatagggcctgtcggcctggactatat
cgcaggagccgtcagggcagccgggaaccaggcagacgtagttgatttatgtcttgctgatgacccgtcaaagactctcc
agggctatttcgctacgcacagcccgcaattggtgggggtctcttttcgcaatgtggacgattctttctggccaagcgcc
cggtggttcgtccccgacctggctgacactatccgtacgatacgaagtatgacggatgcaccaattgtagttggcggcgt
tggcttttccatttttttccgagcgaatcgtcgaatataccggcgctgactttgggattcggggcgacggagagcaggcaa
tagtttcacttcttaatcagctgcagcggccggaacggcttgaacgcatagatgggttagtccggcggcgcgacggagtt
attcacagcaaccgaccagcgtggcctgcaccgctttctttgcgcaccgaacgtgatgcgattgataacctcgcttactt
caaaaaaggagggcagtgtggtgtggagaccaaacggggctgtaaccgccgatgcctatattgtgccgacccgctggcta
agggtgcggcagtcaggccgagggccccgtcggaggtcgccgatgaggtccagtctctaataggcaagggaatagaagta
ttgcatttgtgcgactctgagttcaacatctctcaaagccacgcctatgcggtctgcgaagagttcagccgtcgctcatt
tgcgaaaaaggtgcgctggtacacatatatggcggtggtgccattcgatgccgagcttgccggggctatgagcagagcgg
gctgtgtcggtatcgactttaccggcgactctgcgtgcccatcaattctaaagacctatcgccagcggcatcataaagaa
gaccttgcctcggcggtgcgtttgtgccgtgctaacggcataacggttatgatagacctgctgtttggcggcccgggtga
aacgccggaaacggtcgcagagacaatagatttcattaagcaaattgacccggattgcgcaggggctccgctcggtataa
gaatctaccccggcaccgaaatggcccgaatagtggcaaacgaaggcccaccggaaacgaacccgaacgttcaccgaaag
tacgaggggcctgtggatttcttcaaaccaacttactatatatctgaagccctcggtgagcagccggccgggcttatcaa
ggatttgatttcggcagatgaaagattctttgagccgatgccggaaatagccccggaggctctaaaaagtagccagtcca
ccgaccacaattacaatgataataccgaacttgtagaagcaatcagcaaaggtgcacgcggggcatattgggatatactg
cgcaagcttcgctgcgactaagcagcttatggtagtagatgattcccgcctgcgggagattggcccgaatcctgaggaat
ttgttagaagcggatgcaatgttgatttttggggtaaaaacgggggcagggggatttggtccccggtttgaggattccga
gaagcccacccgtagggatctccgctcccttagggataaattcgcttcgagtttgaaattggtccccggtttgaggattc
cgagaagctcacccgtagtgatctccgcttcgcttcggctttgtttgggtttgttttcccgcgtctgcgaagtggttca
ttttcataatcctttataacatataagtttacgttcattttgggctttcggcaaattgggtttgaattgggtttgttttt
ttggactgcgaaatcatcttttttttctgtaaacctttgttataagagagtttacattcatttgggcatttagtaaattgg
gtttgattggctttgaattgggtttgttttcaccaagtgtccaattggatttattttcataatcctttgtattatatgga
ttacgttcatttgagcatccagaaaattggctttgttttgcataaaaagggctgatttgtagaggactctttacagttg
tagagggcaagttagttaagagtgagctaaagtgcctaaagtgaactaaagttggattctcgattctcgtatagcgtata
gcgtatttcacggttattcaccattcattaaggaataaatttgattaggcctgctggcccctccggcgattagtaaatgg
ttctcggcggcaaaacaacgcgcctctataattgggcgaacatgcacgtttgagtcgaaaattggtgctttcttgacagg
ataaacaggagtaactcgttgtgagaaaaggagtaaaatttttttttcaattttccgattttaggttccaactacctgcac
ttttgattgaaaaatcacaaatgtcttgcctattttaacgcagtttttcgtcgaaacgtcagcgaactaggaaaataggc
gatttctgggggaaaacaaataaaaaaatgcacaaaagtgacaaaaaaacggccaaaaaagtgctttttttggctgccttt
accccgtgagatgatttaccaaaccttcctctgctattcctatgcaagtttgctcagggctggtgtgaatactataaaaa
tttgtgctgtaatcactccacaaatcggaggcttcttcagcgtggaaattctggaggccaaaatgaaatacgctgtaatc
accccacaaatcggaggcttcttcagcttcactacctctcaaatcgcccaactatacgctgtaatcaccccacaaatcgg
aggcttcttcagctcgcaagtcccgtccacgcacaaagtttgagctgtaatcaccccacaaatcggaggcttcttcagca -continued tgagcttttggttgtgctggatatgccagctgtaatcaccccacaaatcggaggcttcttcagcacaaaacggttcaaca aggtcgaagaactagctgtaatcaccccacaaatcggaggcttcttcagcttctgcggagtctttcgccggtgttcaaat gctgtaatcaccccacaaatcggaggcttcttcagcctatcctttataatacattttcctatatagatttacaatacaaa acccacgacaaaactgacttcttcttttgaatcatgccgtattataacactttttttacactatcaaagaccactttttttt ctattccttctcttttcacgaccccatagaatctcttcagatgttccctctcaaaattgagattatagtgcaaaagcgca tttcgcacccgctttaaagcaacctgttgatcattattataaccgcttctattcattatctcctgaaattctatataatt ttttgctggtttaatctttcttcgttcgataatccttccttcaagctttagtattgcatcgattccctctttttgaaggt ttgtatatttgtcgaacgcccttgcatagtgcttatggtagtctatttcttttgcttcttttgggataaaatattcccaa agtctgcttaaaaattcaggatcgtccattacatacatctttgtataatccaagatcgaaaagcgtatcgaaaaactctt cttttgctcttttggattttggaatttgaaaataatcacttctctgccatcttccttcttccaatagatatgctgtgcct tttctgcaagtttttcgttcaatctgagataatattgccttgccatcataaggcaaagtctgtccattgccagtgtttca tatagcttcttgtttgttctgtcaaatcgatcaagagatgggatgttataatactcttcaccaagaggaatatcaaaatc cgaccactttgtcttaattgcttcttcaacaagtctggcaaaactctttttgtcttctttgaagaattcgtatctcaaaa atcccttataaacaaccggctgttccaaaatcctatctaccttttctctaaaagttacctctttttcttctttaggtatc agcccaatatattccttgagattctccgattgcaaactgcccagttcttgtagaaccaaatcacataccctttcatgaag tgcattgagcgttgtatgcccggaaagcttctggataatatttttgtctaatcgtctggttcttttcagttcttcaagtt cattataaaatccggcgaagtctttgttcactataaactttaaaatattattatattccttcctgctaagtggcctatcg catcgctcgttgatatatctgagtatatcccttccttttcgatgtagttcaagcttcctcgatccctctttttttatccgt ccacttggccttaacatattccaatcgagtctttaaccttttctcatcatcaacctgtaaaagacctagtcttgaacgta cgaatcttggaaggaagtttatagatttttgaatctcctcattacttattttatctaaataaggcaactgcttctttaaa ctactaatatagcggtcaattctttgaattgcctcttcggcttttcccaatagactcaaaagaacaagatatttaagttc ataaactcccatcctgaatacgttggactgtccaccttttttttgagccttcagaataacattatttcgtttaatataaa attggtcttgcttctctttgtcaaaatgaatctcgactaccggcttttccctgtgaaatttgtgtttgttaccatctgtc tcttcgtatcttcgttctccatttaattttacttatgcaaaacatgctgtgtagtctgccaaatccttaagtccata atcctcaagatatttcagtgcaaataatatgaacttgtccgtattattcgctcaactgatcctggcttctctttcgag ttagtttgatatgctgatatatctcagtgggaactcgggacaggtatccgagaatatccctgaacataactgcatcatgg tcctgcgcctgaaccgaataactatccttaagacaatatttggaaaaaaacttgccgtgttatattatattcaccctctgt ttttctaaaccatggacatatcccattaagcgatttaaaaatcttattcaataaaaaaatgagacaaagaatactacac ctgctgatgttatcttatcttcttcttcaaataactctggaaattcaatcgaaatatcttcttgttgtttttttcttcgct tcaaaacggctctttcgtatgctttttccataattatccttatggtgtcatttcgattgaatatcaggcagtcaggcgc gtgaagataatgtgagaaataattccttaaattattagtattcactggccgctatttgaatttatcttttactttgt tttcctctctttttcataaatcagtttttttgtttcctcattaaaccaatcctgtttcatgatttttttcaaatcttgta agtgtttgctcaaataactttggattttcctctaaatttgtttgtgctctattaagaactattgcaaaacaccactttttt ttctccttcatattgctcgatagaatacacttctttattgcttgtttttttttatattttcaaactccatatttttaatcc ccgatcttctactaatataaagtcaaagtggtgcgaaatatcgcaccctaccctctgcctgcgcaggaaagaccaacgg acgattcgatgcagtttgagctgccaggtgatttatcattcaaggggtaaaatagcagaaaagccttaatgtgtcaagg ggatttagatttactatttccaatttacgattttggattgagattgatcggcctaaaagacaggcctcgcaatgaccc ccttagagttgaaagcactctaaacaagggggcaggcggggggaatatcgaatatcgaatctgaatgtccaatgtcgaag tgcaactgcgcgggaatgacaggtcggcagatttatttaattctgtggccagatccctccgcttcgtccacctgcggtgg acttcggtcgggatgacactgggggtgtgccattgctccgctcg -continued Cas13b-t2 locus (SEQ ID NO: 276)

agccgagtcgatggtagctaaggtgaacgacaagcgtggttatacggagataagttgatgcgactggttatccatgagga cgaagtagattcgatggattggttatatggaattagatcgaaacgtatacctatgaagctcacagtcaaataccaatcgg gatagaaatgcggcgcgcgcaaccttaggcaaaggcttggctgtttcagcgtttccgctttacgtgcccgtttagccttc accatagtccacctttccgcaagcctccctgcgatcccggacagtcggatttcccaaatccggttctggtctcggcccta tttgtcattttctggataaaggccttcctgtacaatttgagacttaagtgctagctcacttgcaccccataattgtacag tttaccagtatcctcgttccgagagtccatggcattcgttccagttcggtgcctggatgcacatgccttactcagaacca ccgagtacccagagcccattgtcaggcgtgggcgctacccactacctggatgactttgaaagtcacctcagaagacatt actatccttcatagctcatacggactcatgcgccagaccaaatccctcccaacgtcttggttttcccttgtacgttagg tctttgcaggttgtcgccagtccctgctgggaaacggccatcccgacattatctctgcaatccttgtataggtgcaagg accataccccgcagcgtcccttcggtgcccttgcccgtttcttcccgaaggactgcggtctcacctcaggatttaaagg ttcgacacgccaattatccgtcgcaatgcaacttcaacaacggggcaaatttcggggctgcagtcattccataacgttca agctcctatacctgctatgccctgcggttgcacccaccactgagcatatatgagctcagggcagccgggccgtttacacc acgcatcgcccggatggttacccattccgagatgtggcatcgctacgtgcctgaatcgggcaactggcacgacgggactt tcacccgctggattgcagccttgtcggctgctccaaatccctgttgccacaaaaatttctctttgaggcatccacgttacg acgtgtcggccacgcttcgtagatatctgaacagcctttcgacttcacgatgcattataatggacatcgtgaatctagc tatgtcatggtcaatcgtagtgtggccaggggccggccaatcgagtatacttgataaagtgttcatgaagctgtattct taatctcccaagagtatgcttcgaacgtttaagaaatgacagatagtggtgaagtggtctgaaaacgggcccgggaggcg aagacgtgagtacaggtacagtgaaatggtttaatgcaagaaggggatacggttttattgtccccgatgatggcggagat gatttatttgttcaccgttcggacattaacacagaggactatgcatcgcgagattattaaggtcggcaacgacatggttg ccgaccatatcaatcataagggcttggataatcgcaaggccaatttgcgagcggcgacgattgcgcagaatgcgtggaac cgccagcgcaaaagaagcggatttatgggcgtagtgtggaataagcagatgaggaaatggcgtgttaatatcagtcacga gggcacgtgcaggcatatcggctacttcgatgatgaggttgaagcggcgaaggcgcacgaccgggcagcgaaaaaatatc acggagagttcgcgagtttgaatttcacgcgttaaagccacatcacagcgagtccgactatggcggacgcagcaatctta agcatatttggctgcgcaatgtgttgcgcgggttcctgcttggggcgagctatcgaggtgtaatcaccccacaaatcggg ggcttctccagcgccgtaaaagttgataagaattttagatgcgccgtaatcacccctcaaatcgggggcttctccagcgc tgaccgaattgataaaaccaagagagcgctgtaatcaccccacaaatcgggggcttctccagctgtacgacaaatcataa cagaatatttgaagctgcaatcaccccacaaatcgggggcttctccagcaaaatgagacaccacgcttgacgtcactgtg ctgtaatcaccccacaaatcgggggcttctccagcttcgagctatatctggctcggtctgatttggctgtaatcacccca caaatcgggggcttctccagcactggcttagcaagttcctttgggcgtttcgctgtaatcaccccacaaatcgggggctt ctccagctaatcgaagatgagaccgaagactatcactgctgtaatcaccccacaaatcgggggcttctccagctgattgg gaaagcactccttacgcacgagagctgtaatcaccccacaaatcgggggcttctccagcacatcctcgataatacgttat ctcgattggatttacaacagaaaaatcactgaaaataccagggtttttggtgcaatgcgcacacattagaacctgttttc atactgctaaagaccagctttttcaatcccttccctttttcataattccacagaacctcttaaaatctgccctggcaaaa ttaaggttatgatgcaaaagcgcgtttcgcacacgtcggagagctttctggtcatcttcattgtaggcgcttttccat tatctcgctaaatgggatgtagttctttggaggtcttggctgctctggaccgatagtctttttcaagctcgagtatgg cttcaattccttccctttgcaggtttgtgtatctgttcatcccttgcgtataaagcctatggtagtcgatttgttcttcg tcttttggcaaaaaaataatcgcaaagtcgggccaaaaactccgcgtcgtccatcacatagagtttcgtataatccctcag cgagaaccgtaccgaacaactctgctccggctgtgccggattcttcaaggtgaaaataattacttcttcgccatcctctt tcttccactcgatttgctgtgccctcttggcaagctctttgttaagactaagatgatattgccttgcgatcatcagcaaa -continued agcctgtccattgccagtgtttcatacagtctcttattgtctttatcaaacgtatcaagtgacacgatttcgtaatactc
ccccccagaggaacatcataaacctctcctttttccctcaccgcttcttcaacaagcctcgcaaaactctttctgcttt
ctctgaagaattcattcctcaaaaatcctttataaataaccggctttcacaaccctgtccgtcttttcttcaaatgac
acctcttttcttctttgggtatcagtccaacatattccttcagttcttctctgcctaggctttcaagttcttgcacgac
caaatcgcacaccttttcgtgcagcgcattgacgcttttgcctggaaagattgcacacgatgttcttatctatccgtc
tggtcttcttcaattcttcaagctctcggtaaaacccgtcgaggtgcttagtgaccaaaagctccaaaatacggttatat
tcatcgatgttcagcggcctctcacaccgctcattgatatacctcagaatatcccgtccttttcgatggagctgaagctc
cctcgactttctttttccaaccacttggccttaacataatcaactcgcgccttgatctttttcatcatcaaccc
ctaagagacccagatgggaacgcacaaacctcggaagaaatctcacgtatccttcaatctcttccgtgcttttcttctct
atgtgaggcaactggttgcgcaagctatgaacatacctgtcgattcttttgactgcctctgctccttttcctaataagct
cagtagaacaagatatttaagctcgtagacgcccatcctgaatatataggtttgggcgcctttcttctgagttcgcagaa
tgacgttattgtgtttgatataaaatgggtctccttcggctctctcaaaatgaatctcgactctcggcttcttcctgtga
ggtttctgctccttgccatctgtattttcgtcctgctcccgcttaatcctcgttctggcaaaacatgctgtgtagtctgc
caaatcctccagcccgtaatcctcaagatagttcagcgcaaacaatatgaacttgtccgtattattcgcttaactggg
tttcgcttcgcatttgcgattattgatacgctgatacgactcactgggaactcgtgacaaataccccagaatatcccgg
aacatgaccgcatcatgatccggcgtataaccgaataactgtccctaagacaatatgtcgaaaaaacgtcccgcgttat
tttatattcccccctctgtacgcgtaaacccctgaacatatcccattaaccgatttaggaaccttctctcagcaaaaaatg
acgcgaaaaataccacacctgctgatgttatcctgccgttctatcgaacaactccccaaattcaatcgaaatatcttcc
tgttcctttttttgcctgttcaaaacgcgccttttcgtacgcttttttccataattatcctgaccgggtcattttgggtgaa
tatcaggcagtcaggcgtatgaaaatagtgcgagaaataattcctcaaatctctaagatttcatcagccgctttttgaa
tttcctcctctacttcgttttgttcttgttttgcatagatcagtttttttcgtttcctggtcaaaccaatcttcctttctg
atcctttcgaatcgtgtcagcgtttcctcgaacaacttcggattcccctgcaaatttgtttgcgccctattaagcactat
cgcaaaacaccacttatggccccctcatattgctcgatagaatacattccttggctgcttcattcttgatattttcaa
cctgcatatctcagactctcccaattgttgtttttcgccatttttgttgaagtccccgaatgtcagtctattgggccagc
tgagtcaacccacaaggcacaatgtacatacagtctcgagtcatttcgagaagactttccgctcgcccgataagataagc
tttgagtatctcacggggtggacccgagcagataattccacatctcgtatccggtgaagctatccggcataaattcgtgc
ttagtgaatcgtgtttcgtgttgatacggctcccggctgcattcacttttcacggcagagaatatcgcaaaataaggcaa
cagtcaaaggaaaaagggtaaaaatggtgaaatagatgagcgagcagtgaattgttgtggcaagcaagccgcaaatgaat
ccttcggccacgctc Cas13b-t3 locus (SEQ ID NO: 277)

tatccaaaatgtggtttgaattcaagaatcaacgctttattccttaaaaaggggcggtgcgatggaaaaagaaccagaaa
catccgtgcaatcggcgtcgggacacaatatggatatcccgattgactggtcggtaacctcacgctatttcgaagatgaa
gatacgctgatgcaggtggtggggatatttgctgaagactctccgcagaccgtccgggaccttgccaaggctatacagac
gcaaatatcccaggatgttcaattgcacgctcacagcctgaagggagcctcggctcttatcggggccgaacatctgcggc
aaagagcctggcggcttgaatacgccgcccaggagaaaaacacggcggcgtttgaggcgctgtttgacgagacaaaggcc
gagttcgacaagctgatgtcgttcctttaccgcgccgattggattgaagcagcaaaagaacgccactgcaacaggcaaca
ggccgagcaggtatgaaacatcttttggaaaagaaggcgatggaatgagtggatggttctccattttgatcattgatgat
gacaggatggttacagacaagttggagaagatcagcggcgccaaggctgcaaagaaaaggttcagcctggcaggcgtttt
ctcaaagggcgcctgaagccatttatttgcaggcgtgctaccgcttgtcaacgggcaggggacagaaccgcaatcaggat
taccatcagtttcttcattccattaacctcgctttttcctctcgttctttttcttcttcctggttttcgcagcgttgggc
tgtctttttgccggttttgtatagttgtcgccgtaaatgtcaatgagtgcggcttttagtttttcgggccagttgcggtt -continued

```
ttcaaaagcgcacacgagcggatcgccgctttgtttcatccagttatgaagccggccctgcatcttcttgatttcgctcc

tttgctctgcggaatcgataaggttgttgaggcagtcggggtcatttctgagatcatagaactcctcggccgcgcgatat

ctgaacatcttgacgcgctgtgcggcgaacttattcgttggagcggcctcgaccatcgccttcatggtaaggccctcgtt

gttgtttcggtaccagaatctgccgtcggcccacggattgaagatatagccgaagcgcttatcctggacgcaccgcatcg

ggacagcgtctccgccggctttcatgtctatctgcgtaaagaccacgtcgcgtccggattgcttttcgcctttcaacagc

cccaggaaagaggaaccgtcaagcccctgggtatgcccagaccgaccgcttcgagcaccgtcgggaagaagtcgatccc

tgagataaagtgcgccttatcgacggcgcctgcttttaccatttgcggccaacgaacgatccacggcgtccgcgtgctgg

caagataggcgttgcattttgcaaacggtatggcgatgccgttgtcggagaggaacatcacaagcgtattctcctcgaag

cccgactccttcagggcctgcaacgtcttgccgaaggtatcgtcgagtcggcggacggagttgagatagcagctcagttc

ctgccgaacgcccggcaggtcgcagacaaaaccgggaaccgcaacctcatcgggcttatacgtctttgaaggttcctttg

cccccttgattggcttgccgccgatatgatacgggcgatgcggatcgtgcgagttgaccataaagtagaagggcttattc

tcgcggcgacacctcgccagaaactccttgcagtaaaactgtaatagagttccggatcgcggccggcgccgagttccttct

ggtcatgcacaaaatcccatttgtaatccgcatggggcgttgagtgccccaccttgccgagaataccggtaagatagccg

gcatccctcagcgtctgcatgacagtcatcaccaaggcggcgcccaatcctgcggcccttagaaaatcacgacgattcat

cattgtccccactaatccttattgttcttctcaagataccccgacaatttctgcatttgccgatacaggccgccgggaca

tatcagtatagccgcaaaccttgaaaatatcaacctcccggaatataacgtcgacttccaacccagatcgccaatccaga

ataagaaaacaaagcaaaacgcttcaaattcgtttaaccccagggttcgcctgaggttcgtaaacaccatctcgatgtac

atcgggattcaaattcgttgagccccagcccttcttgtggctcttgttcggcaagaaacgctgtaatcaccccacaaatc

gggggctgctccagcatcgccaagacgggcaatgccgctttgaggctgtaatcaccccacaaatcgggggctgctccagc

tgatttcgagtttcgatgctttcggacagggctgtaatcaccccacaaatcgggggctgctccagcactccttatggaga

aggagcttatcgtgtcgctgtaatcaccccacaaatcgggggctgctccagcttattccttccatcatcccgacagcagt

gggctgtaatcaccccacaaatcgggggctgctccagcccactttcgtaaccattttactcgcaaacgcttataacgaaa

acactttccaaaaaccataccaacgtcctcatttaacaggaaacttccactccttttcaattccatatttcttcataaca

tcactaaacaacccaaattcatctatcacaaactttaaatgatgatggaaaaacgctctacgcaccttattcacggcggt

cttctccgcctctttacacattgtttgtgccagtatctcacgaaaatcaatataatgcgccccttccttctcgctcatct

ttttggctttgacaaccttctcttcaaacgccagcaccgcctcgacacatttcttctgcagatcattatatgccctaaac

cctttttcgtaaactgtatgataccgtatcttccctttttcgtgcggcataaagtactcacatatccgcccaagaaactc

agcgtcatccaacacatataacttgccgtaatcactcactgagaagacgatgctttttcgttacccactgagccctcca

cgggcaactcgatgctatcattcgaccacacaattttattacccaattccttgcgtacactccccaggaagtattgcgcc

atcatcagacacaaacggtctcgcgccagcgtttcatacaaggctggattagcaccctcgaatcgcccaatcgcatcaat

atgataatacttttttatccagcccaacgtccctctgtccgccgccgctttccaaatgctcttccacaagcttcgcgaatc

ccttcttgctgtcataccagaacttcttgcgcaagaaacccctgcggatagaaatatgctccttgaaccatgcaaccttc

tgcttgtaatctatttcatccttcttcccaagccccacataatcgtagagcttctgatcgccgattcggcaaagtctgtt

gagaatctgatcacacaccacctgatgcatctcgtttattgtggaggtctgcgcaaaaattgaatatacccgcccgtcga

ttcgctcggccagttgcaggcgtttcagtcccgcctgaaaattctcaacatccttgccaaccagacacaccagcagccgg

ttgtactcgccgggattgaaagacctcgtgcaattttcatttacgtattgaagaatgtcccgcgccttctcgtgaagtgt

catctcgttggtcgccgccttcttcttttcccacacccctcgaacatgctttactctgccgtctattctttgcttaaaag

ctttcctgccaatcccatgttgctccagcacaaatcgcggcaggaagacgtgattatccttatctgtgaccttcactaca

tccagaatgttctccacatgctgccgatacctgtacagttttgcaatcgcatcgtcgccctttccctgaaggctaagcaa

tacaaggtatttcaattcgttaagccccatgcgataactccgaggcccggcattcttatcaatcctgacgataacattgt
```

-continued

```
tcttactgatatagtatgactgatcttcgtctttttttgaaaagtcgacaactaccttgcctttggtcctgtgctttttg
tgttcgtcgcctgccccggcctcctccctgacaatgtgtcgccgcccgaagcatatctcactgtgttgcgcctccagata
atgcagtgcaaactcgatgaacttgtctttatggcgtttcggattcgtcccctcattgtcgtttgctcttttcttgtcgc
cctgctctccgtggtagtattcatacgcctccgcagggatgcgtccaagctgcgcgagtatatccctgaaaagcagcacg
cgtttgtcccacgccttcgtgaaacgactgtctttcaggcaatacatcgaaagcgccttccgagtcagcttgtactgtcc
ttcgtttttcttaagcccacttaccgcaccgtacaaacgatccagcacccgccgttcaacaaagaacgaaacgaaaaaca
caacccccgccgtagtgatccggtcgccttcgaacaggctgggaaactcgatgatcacttcagtttcgcgtctcctgcat
tcaaagatcgcccgctcatacgccctttccatgattgtccgcaactcatcttctgctgtaaatgtcagacacccgggcga
atgtcgatagtgggagaaatagtttcttaacgcctcggccttcgcattggccgcttgtgtgctacacttgatcaaagcgc
gtgtatcctcatcgtaccagtcgtgctttgaatacttttcatggcgtaacagcgactcgacaaaaagcccgtcgttctta
tctcgattcacaagagccttgttgaaggcaatcgtaaaacaccatttccgagcaccttgatattcatcgatagacaactc
tctctttttcgaagtctgctttgacacttgcgccattgagcacctcccattccagattttagtgcgatctttacctcatg
cctccacaacactcccagcgccaaacgttgagcaaagcaaaatacgccgcaggcgggctccgtcgaatccgtaatcctaa
tttctaacttcccaatcatctaaaccgcccgcaaccgatttgtcaaccaaaaaccacatcaatccgcagatggccgcaga
taaccgcagatattgcaactaatccacccaacccaaaacctctgttccatctgcgccctctgcgaaatctgcggacagct
ttttttttcgtgcccttcatgtcttcgtggtgaatttcatttaacatttgacaaatatcaaacggcatggtataatgcgt
tgcgtatttaaggacaaagcaacaccaaaaacaggggggagtaaaaaaccgtgtccatccaaaaagaatcgcaggccgcag
gcctgccacctatgattaacctcggtctttcagccaaggatgctccccacacccaaacaagcgaaacgaaccgtgcgcca
agctaagctggtgcaattcagcaggtgtaatcctgcccggtcaaaggttagccgcccggccggaatgaacatgtacgtat
aaggaggcaacaaat
```

Figure 55A:
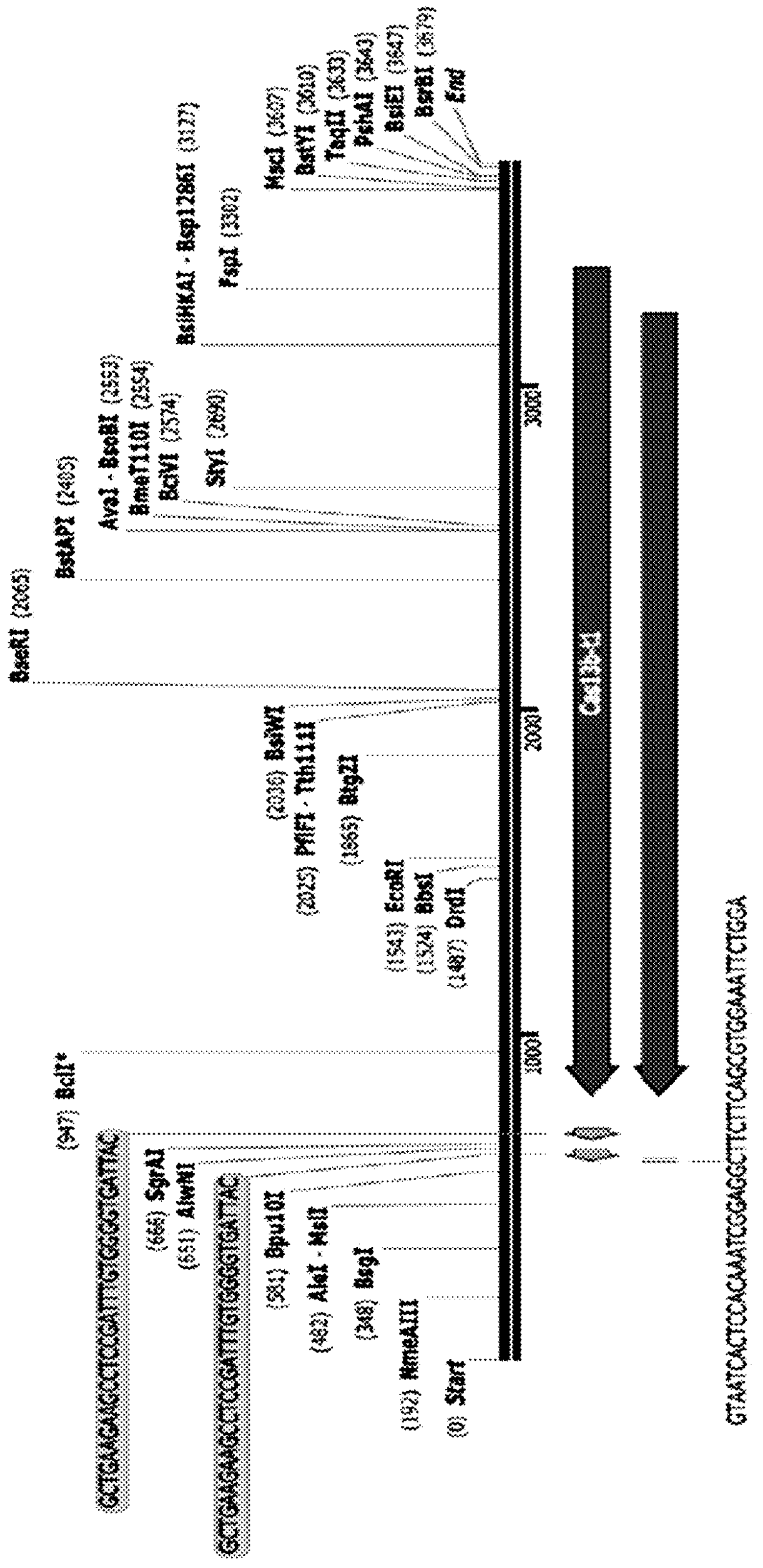
FIGS. 55A-55C show more details on loci of Cas13b-t1, Cas13b-t2, and Cas13b-t3 (SEQ ID NOs:40-45).
Figure 55B:
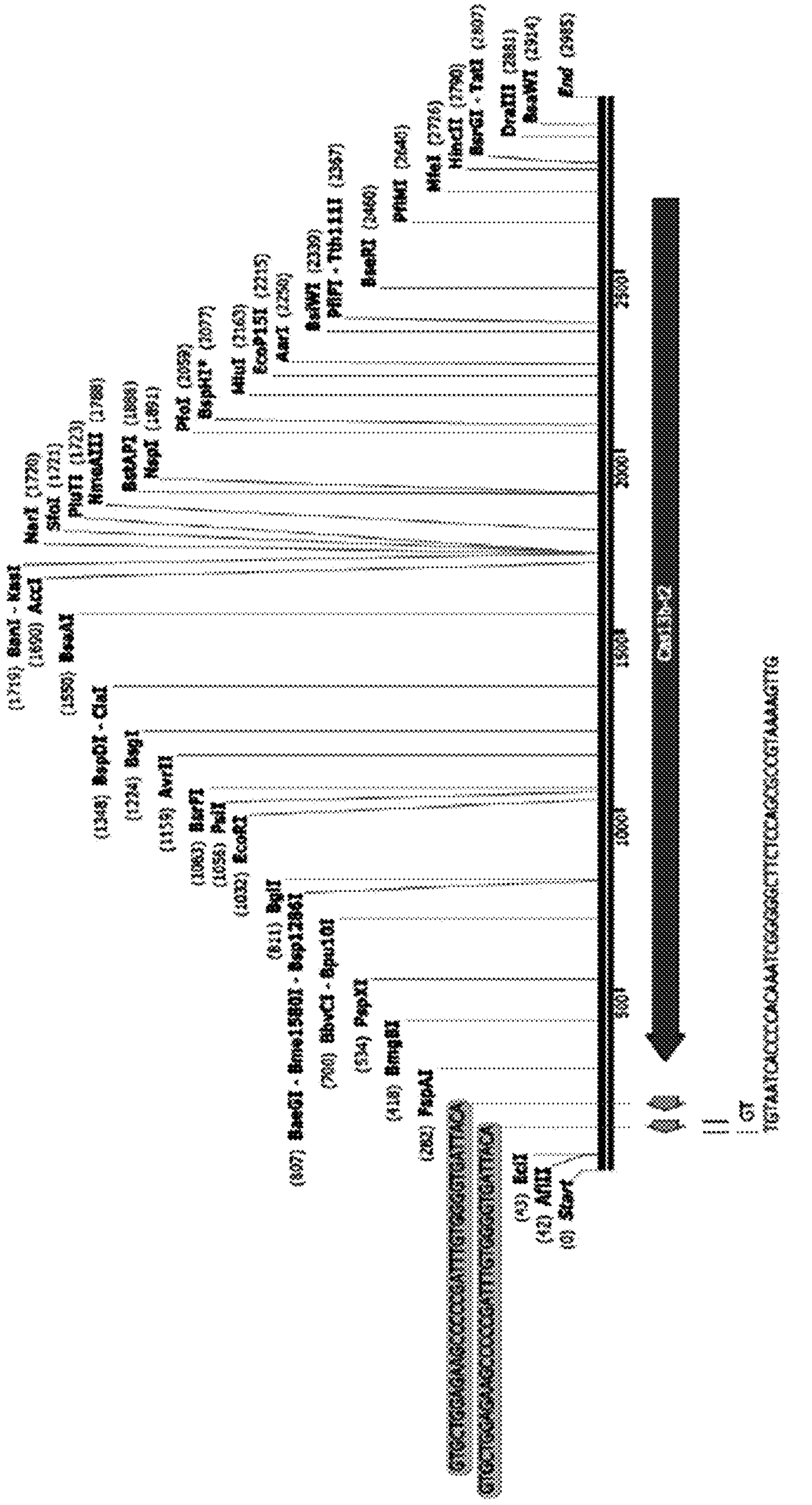
Figure 55C:
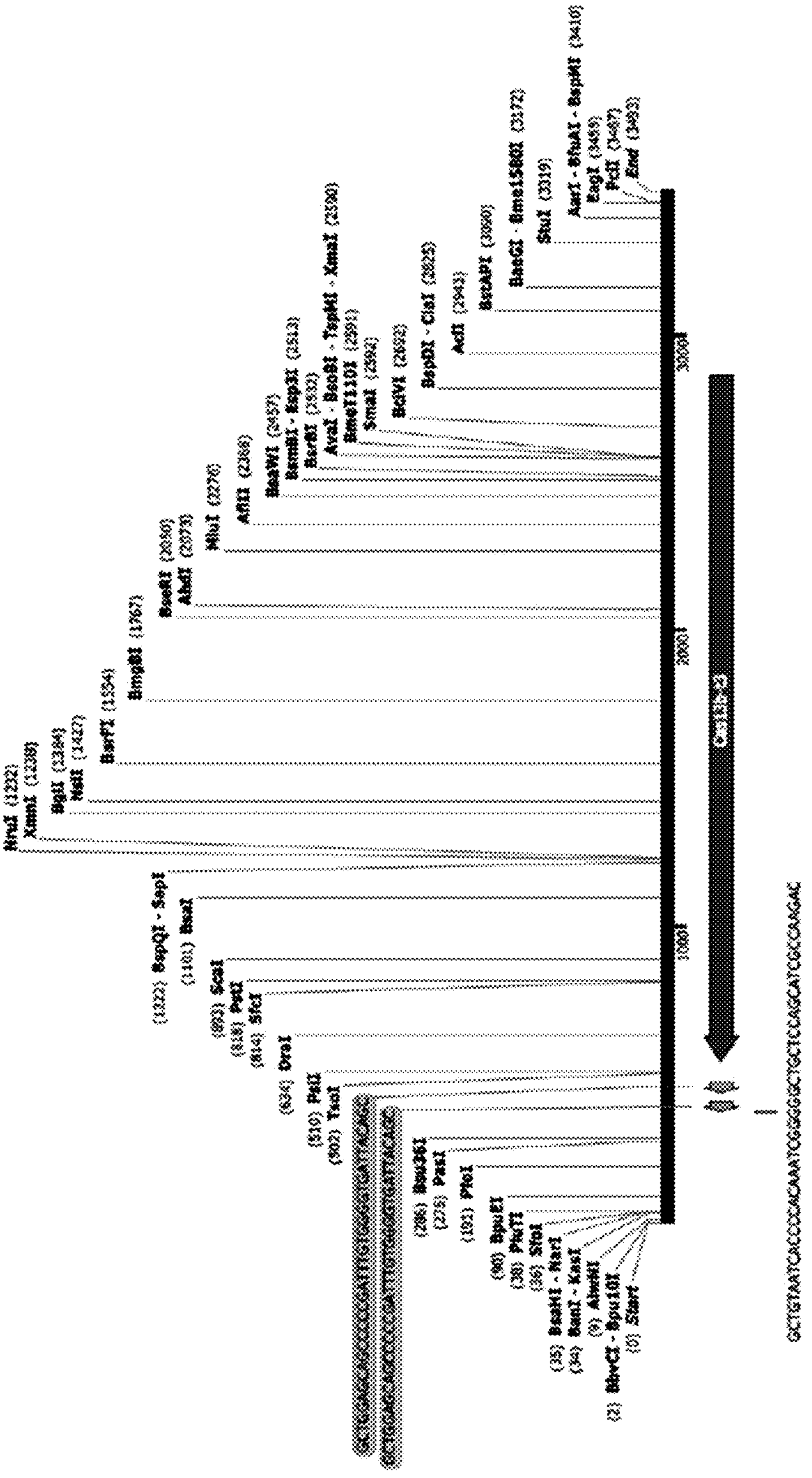

More detailed sequences and features on Cas13b-t loci are shown in FIGS. 55A-55C.

Figure 51:
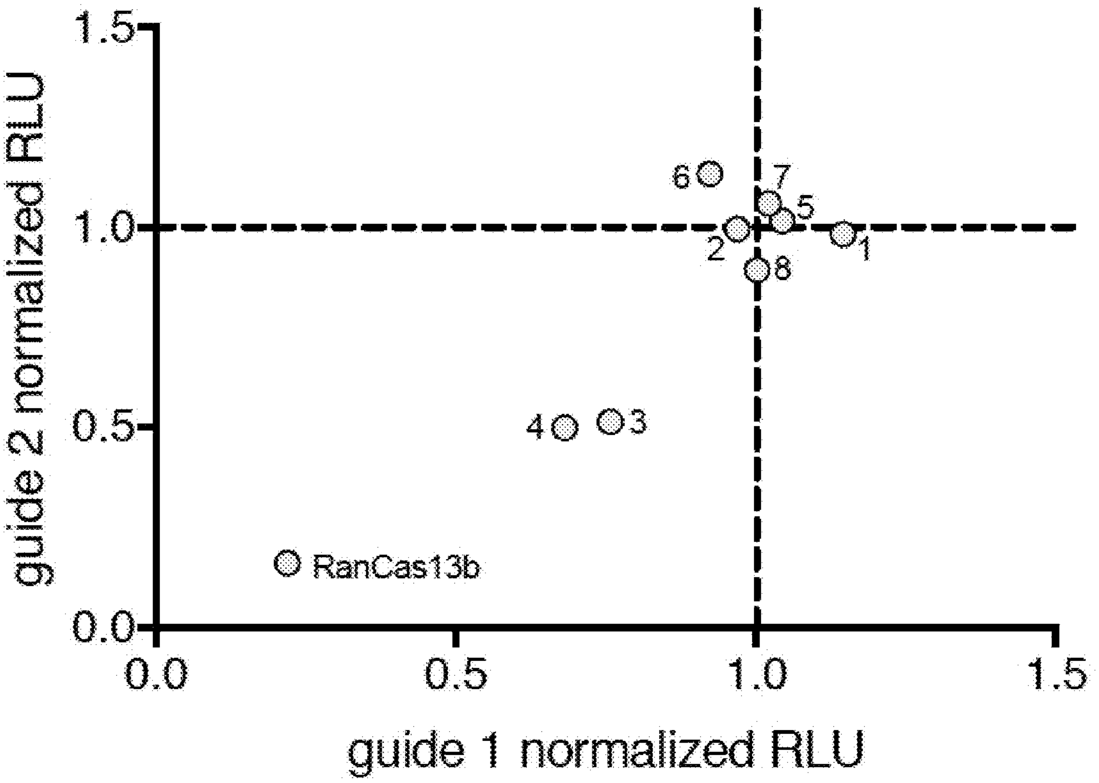
FIG. 51 shows results from Gluc knockdown in mammalian cells by Cas13b-t1.
Figure 52:
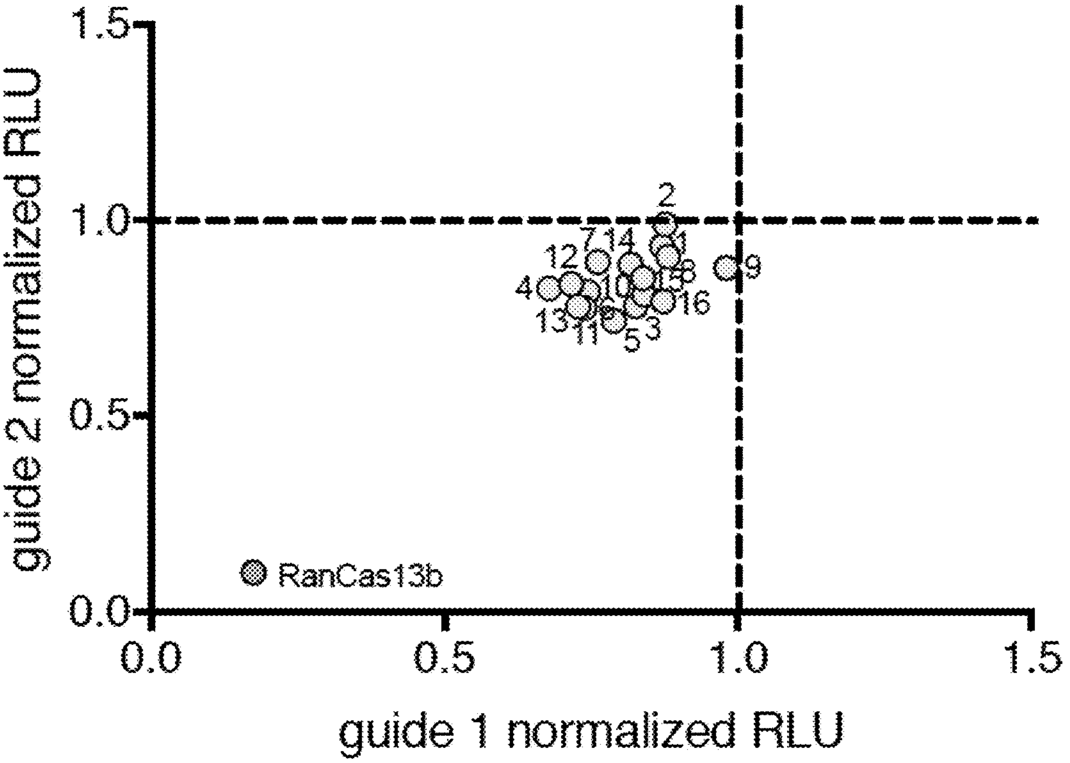
FIG. 52 shows results from Gluc knockdown in mammalian cells by Cas13b-t2.
Figure 53:
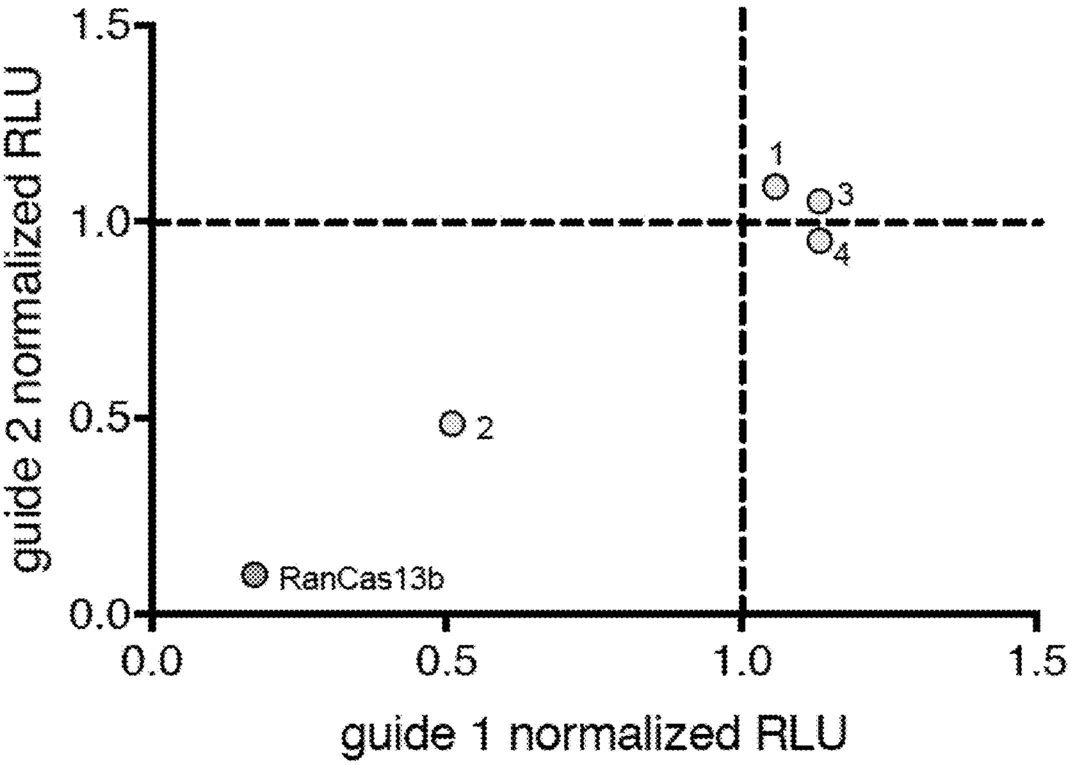
FIG. 53 shows results from Gluc knockdown in mammalian cells by Cas13b-t3.
Figure 56A:
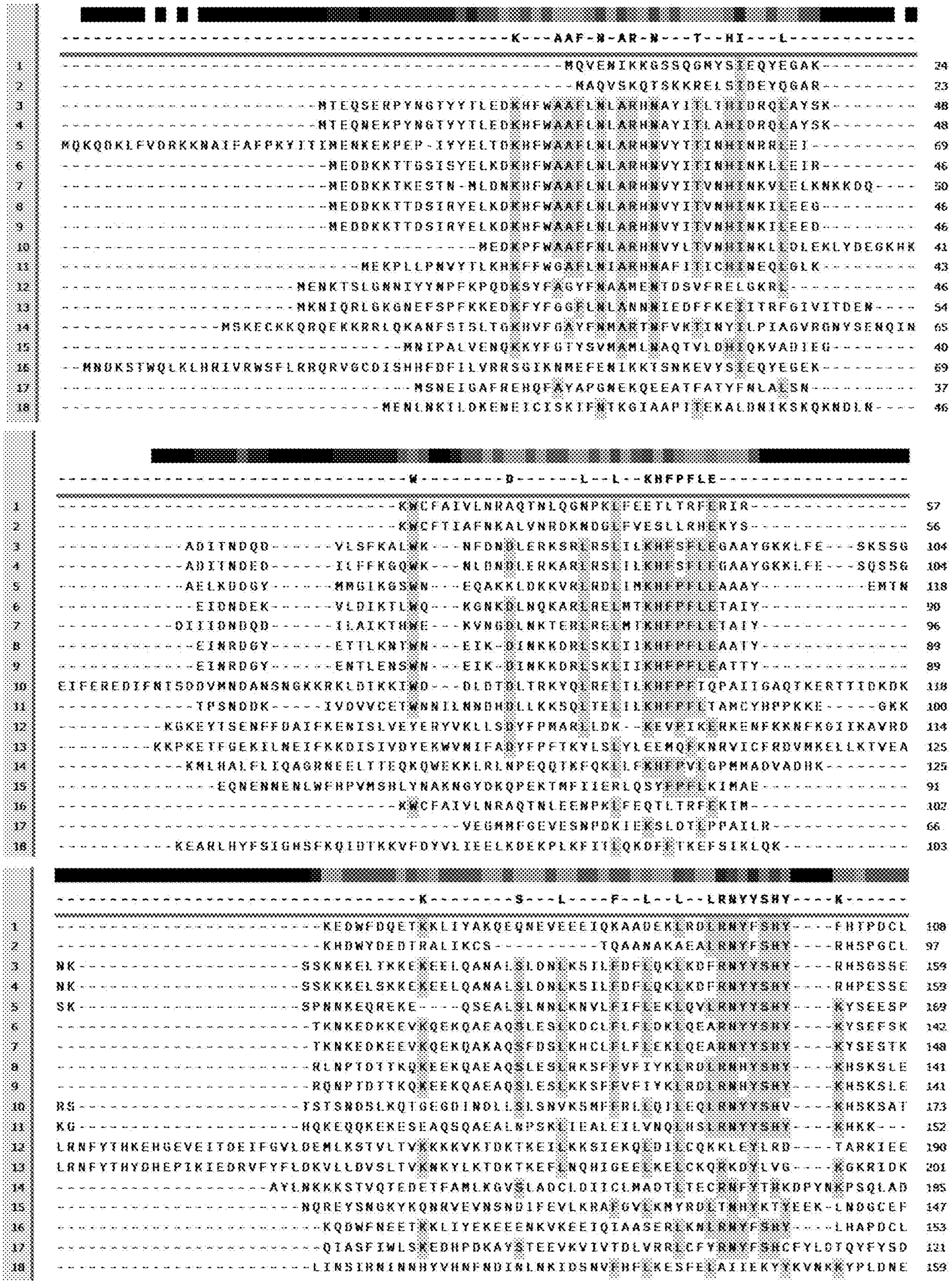
FIG. 56 shows alignments of Cas13b-t1, Cas13b-t2, and Cas13b-t3 with other Cas13b orthologs (SEQ ID NO:46-64).
Figure 56D:
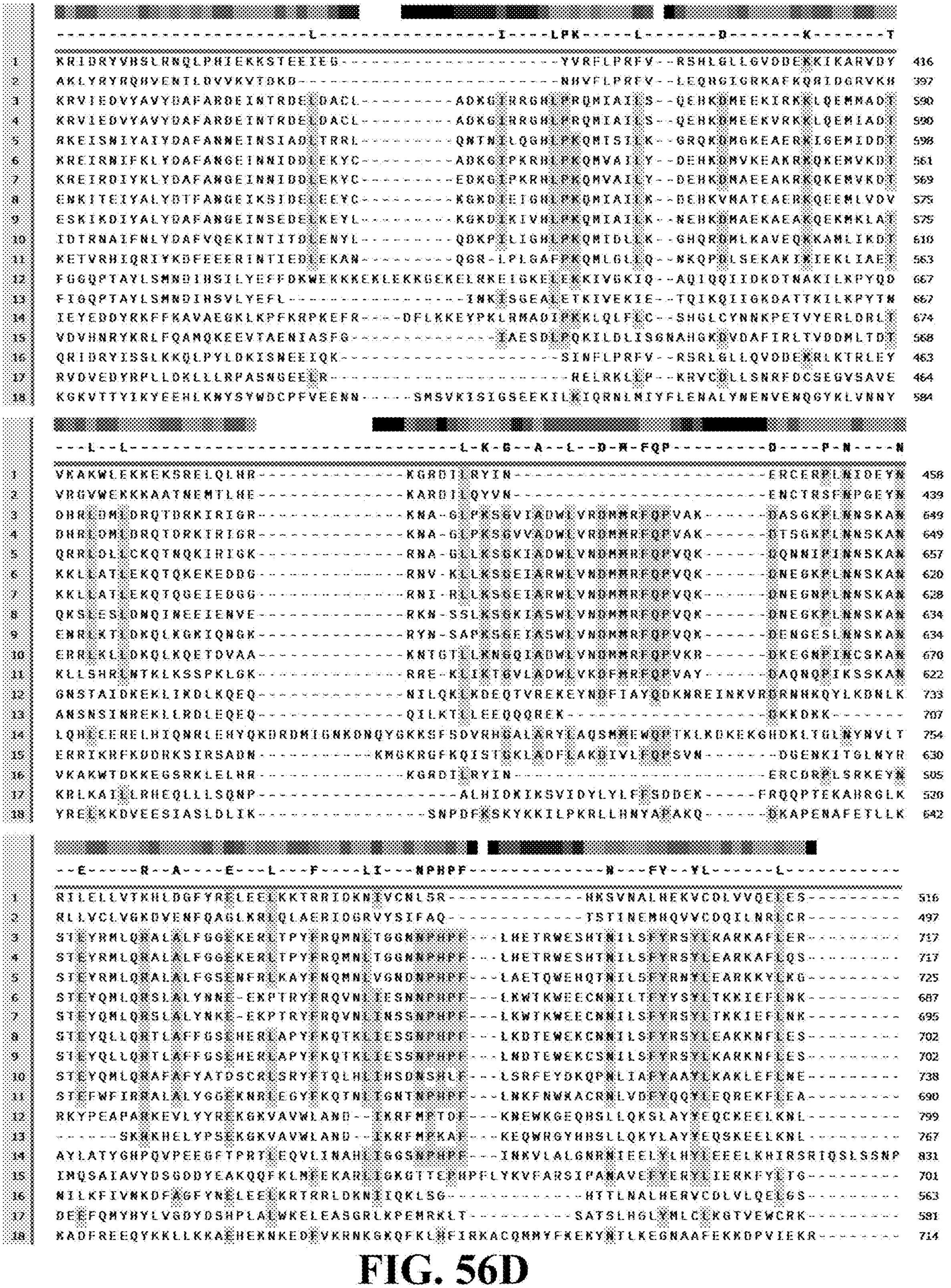
Figure 56F:
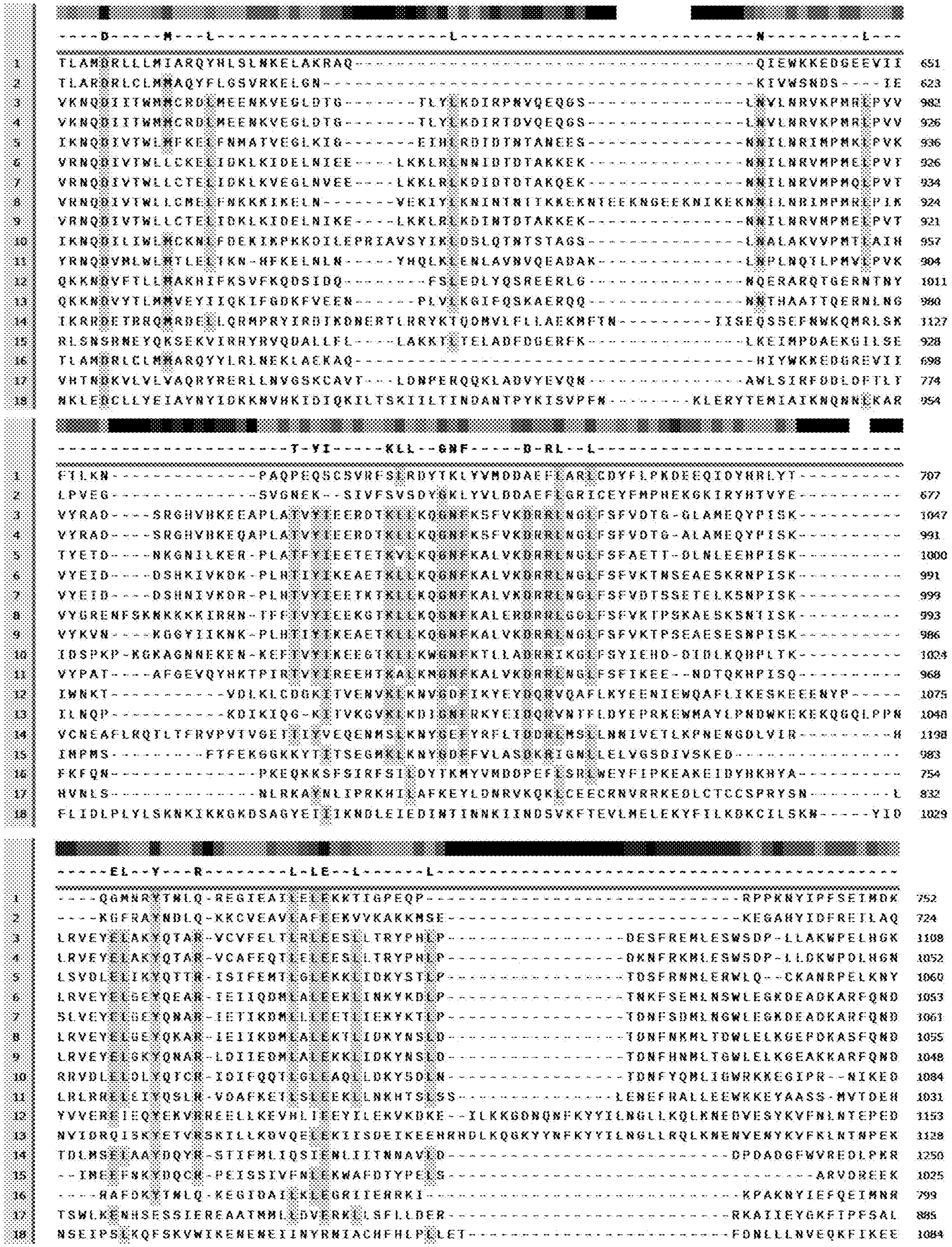
Figure 58:
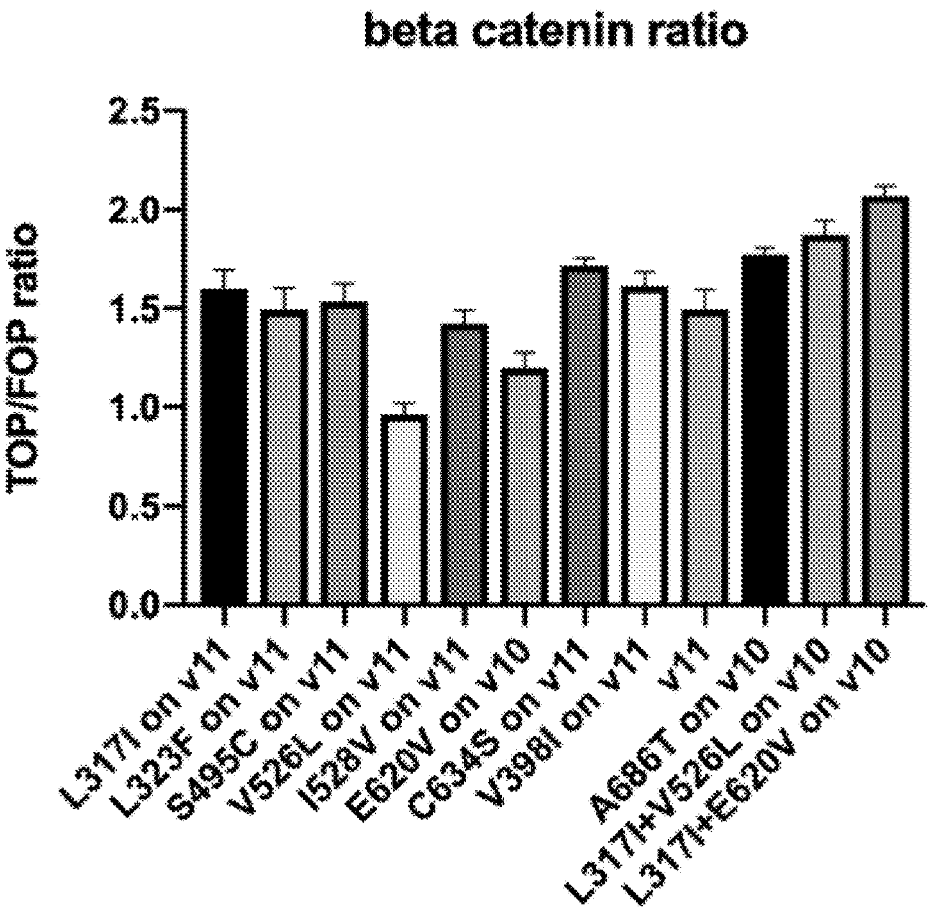
FIG. 58 is a graph illustrating results of an experiment in which better beta catenin mutants were selected.
Figure 59:
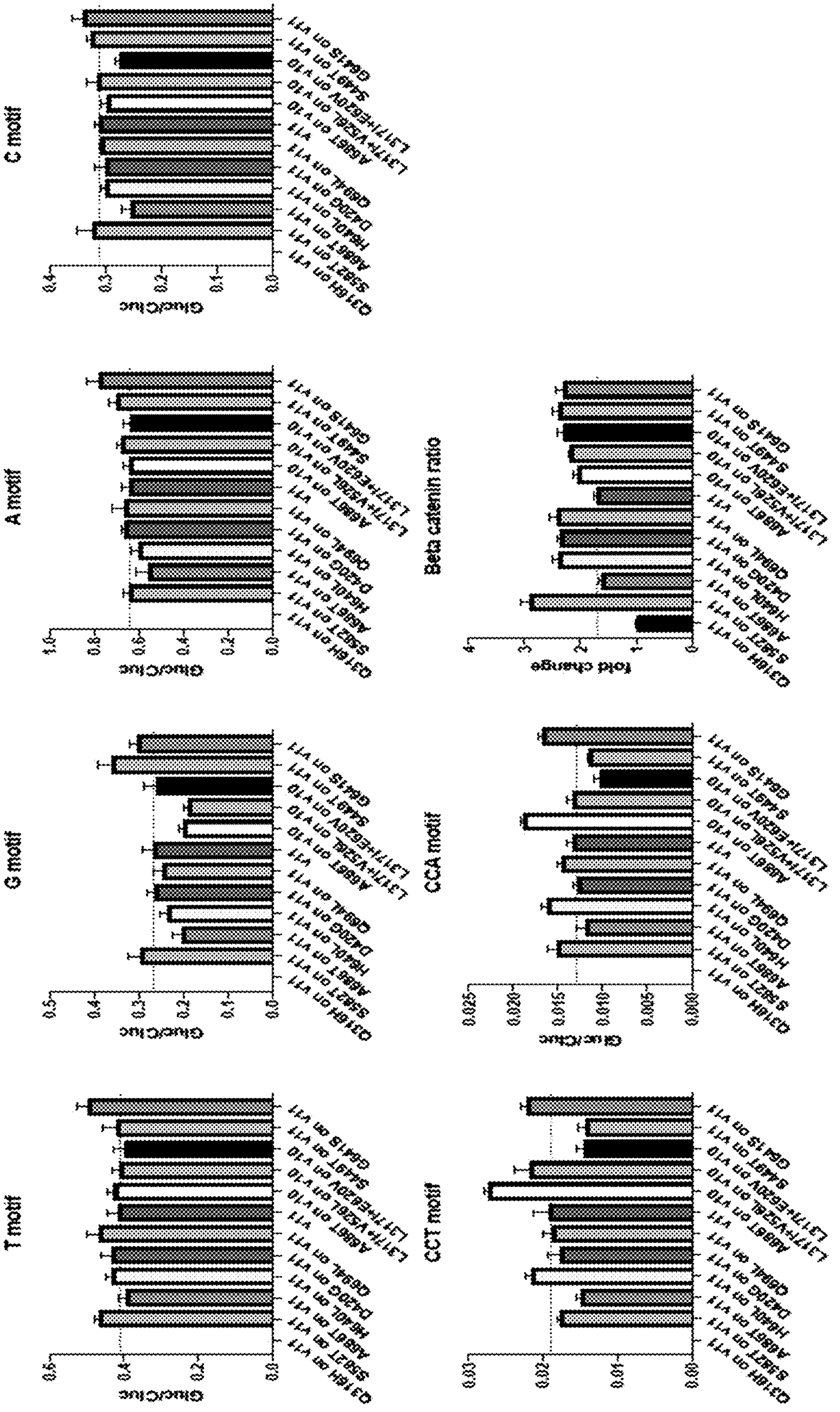
FIG. 59 shows graphs illustrating results of RESCUE round 12.
Figure 60:
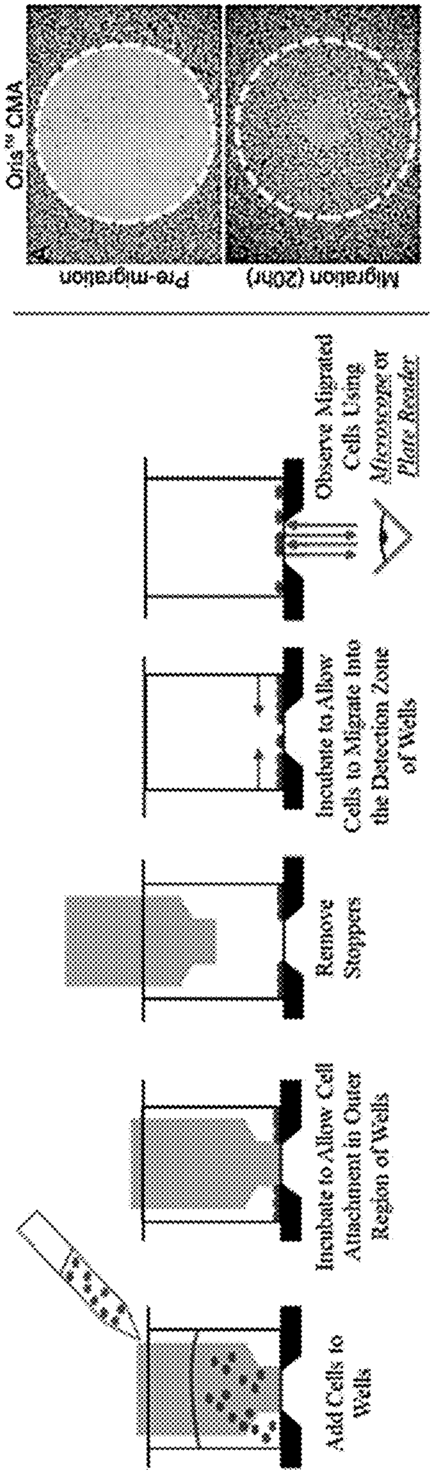
FIG. 60 is a schematic illustrating the beta catenin migration assay.
Figure 61:
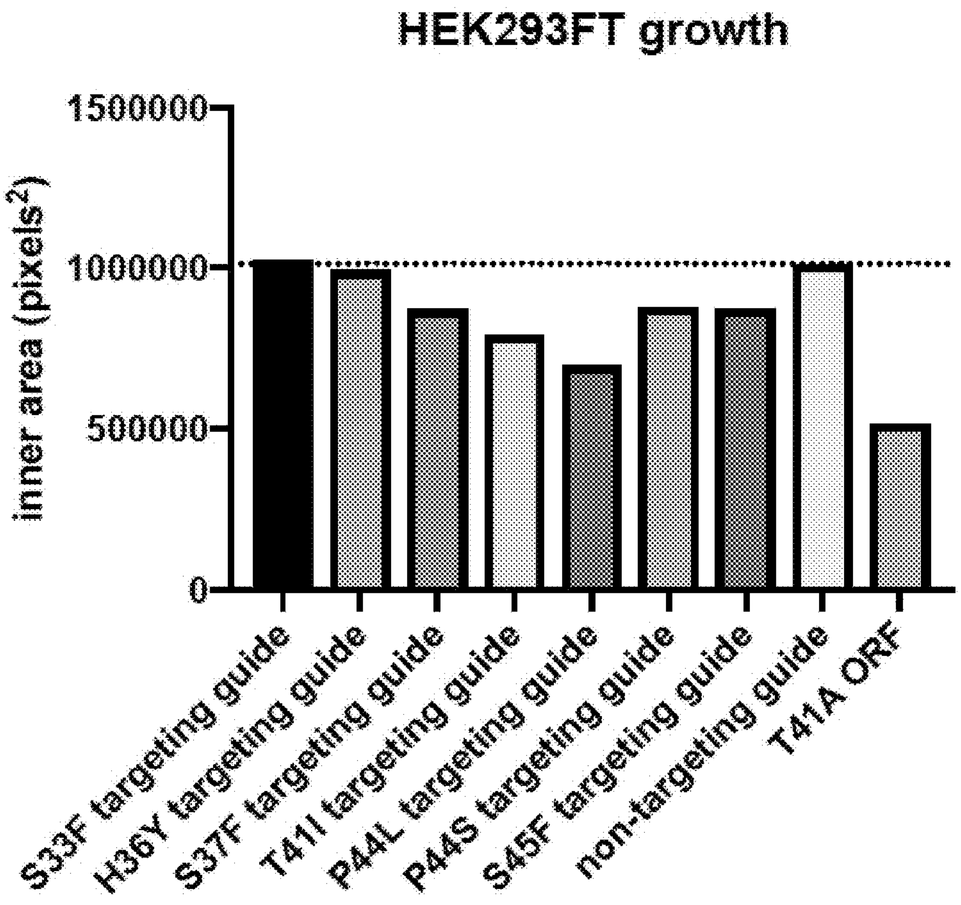
FIG. 61 is a graph showing results of a cell migration assay induced by beta catenin.
Figure 62A:
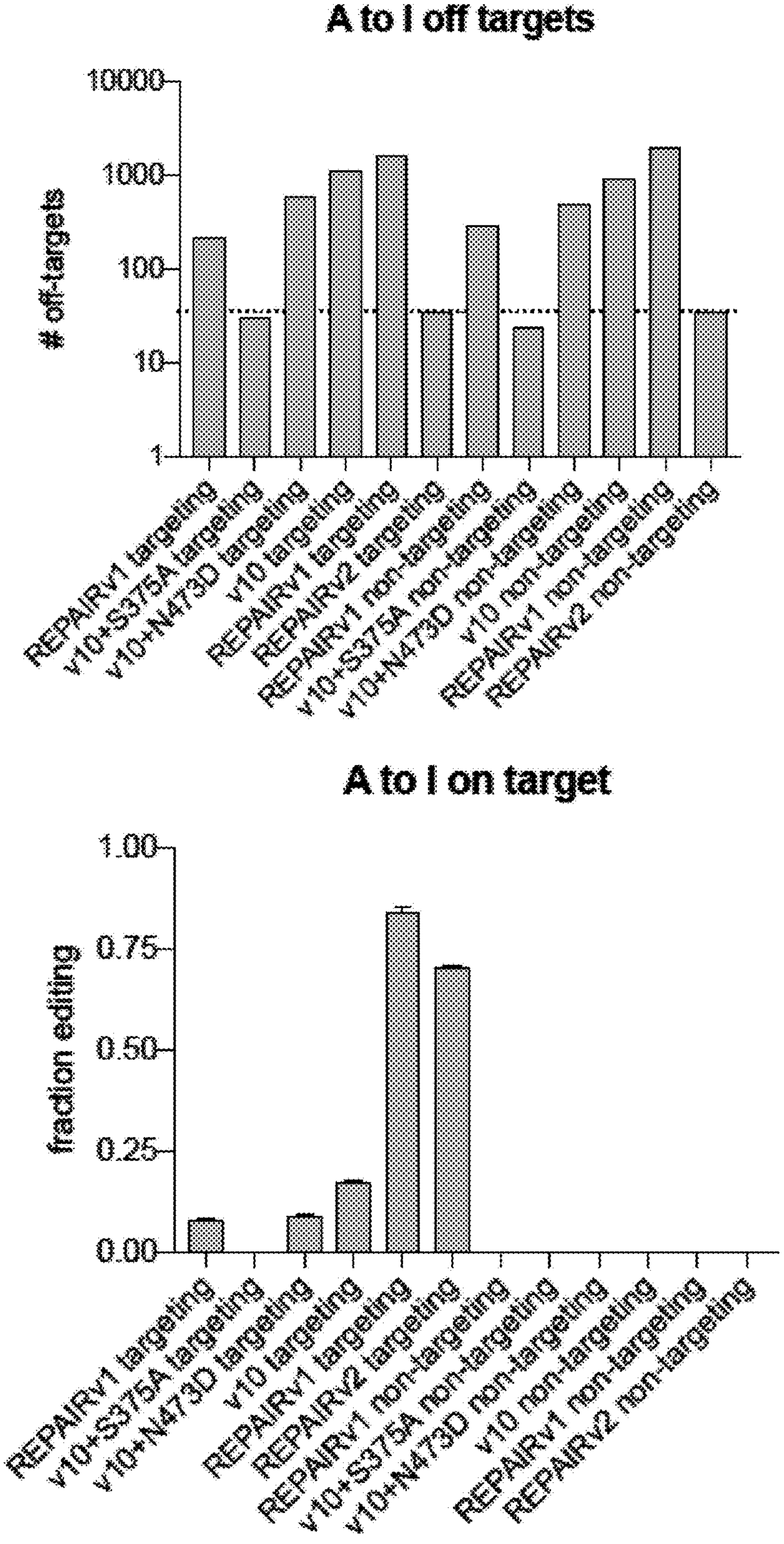
FIG. 62 shows graphs illustrating that specificity mutations eliminate A-I off-targets.
Figure 62B:
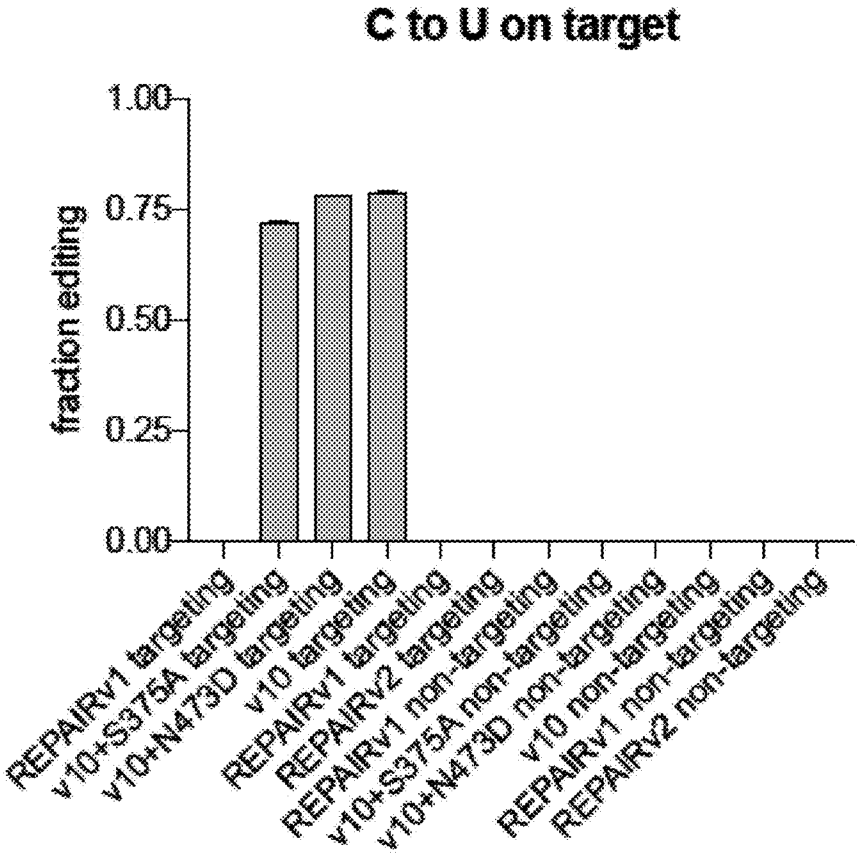
Figure 63A:
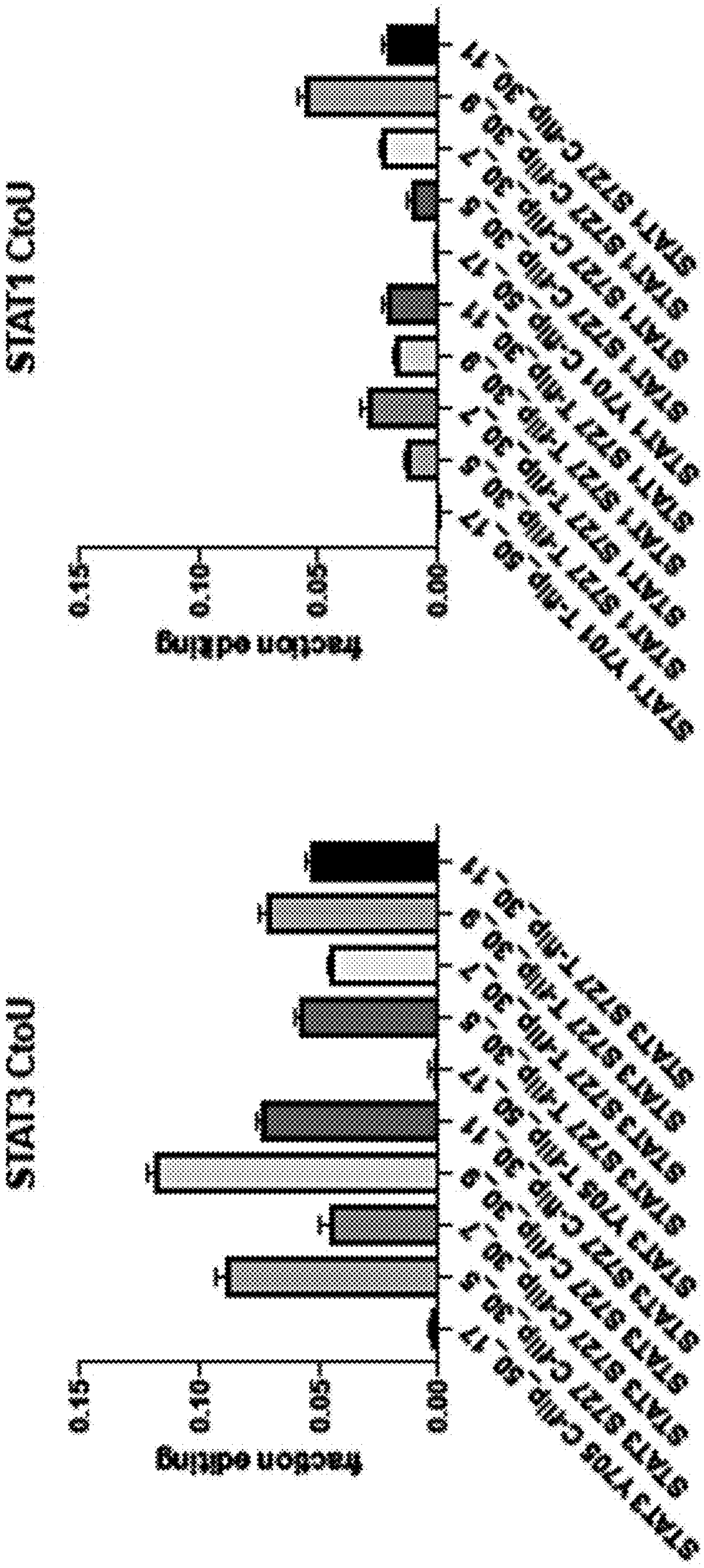
FIG. 63 shows graphs illustrating that targeting Stat1/3 phosphorylation sites reduces signaling.
Figure 63B:
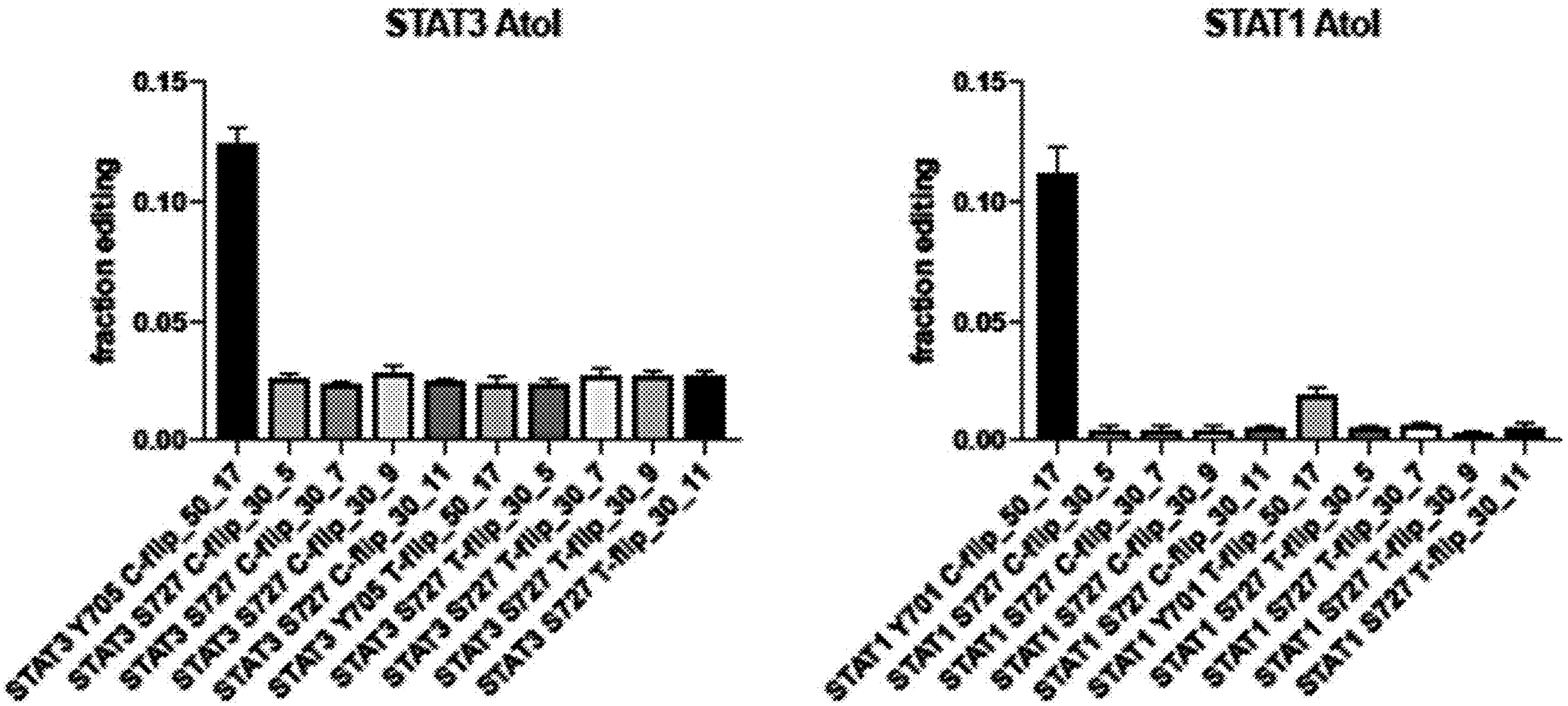
Figure 64:
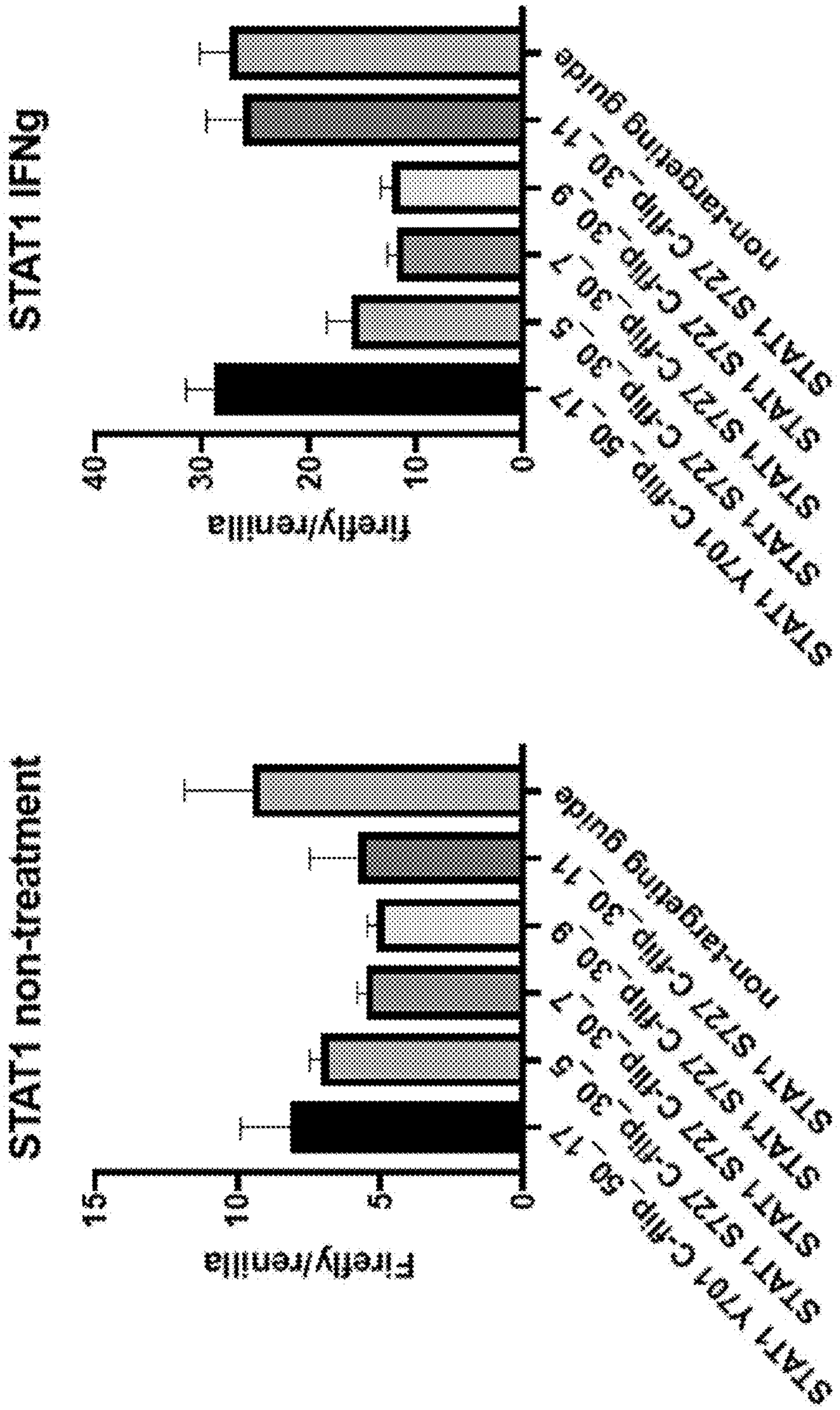
FIG. 64 shows graphs illustrating that targeting Stat1/3 phosphorylation sites reduces signaling (STAT1 non-treatment (left) and STAT1 IFNγ treatment (right)).
Figure 65:
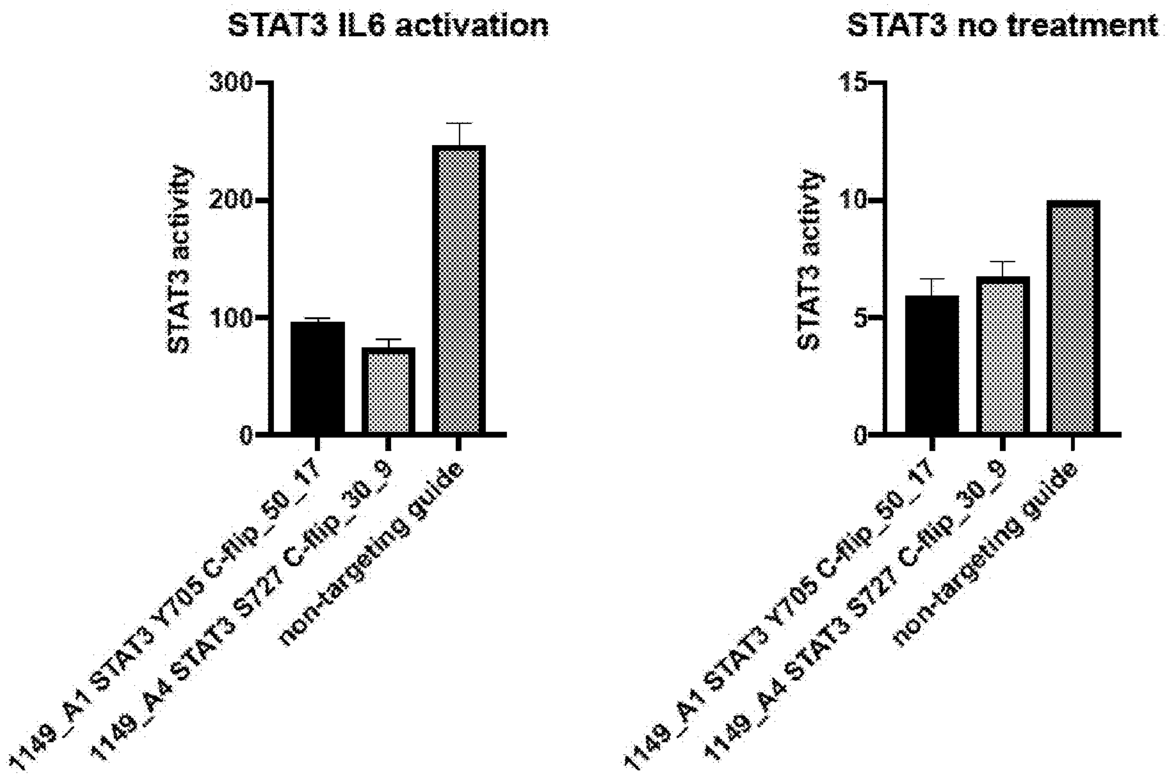
FIG. 65 shows graphs illustrating that targeting Stat1/3 phosphorylation sites reduces signaling, with FIG. 65A showing results for STAT3 IL6 activation and FIG. 65B showing results for STAT3 no treatment.
Figure 66:
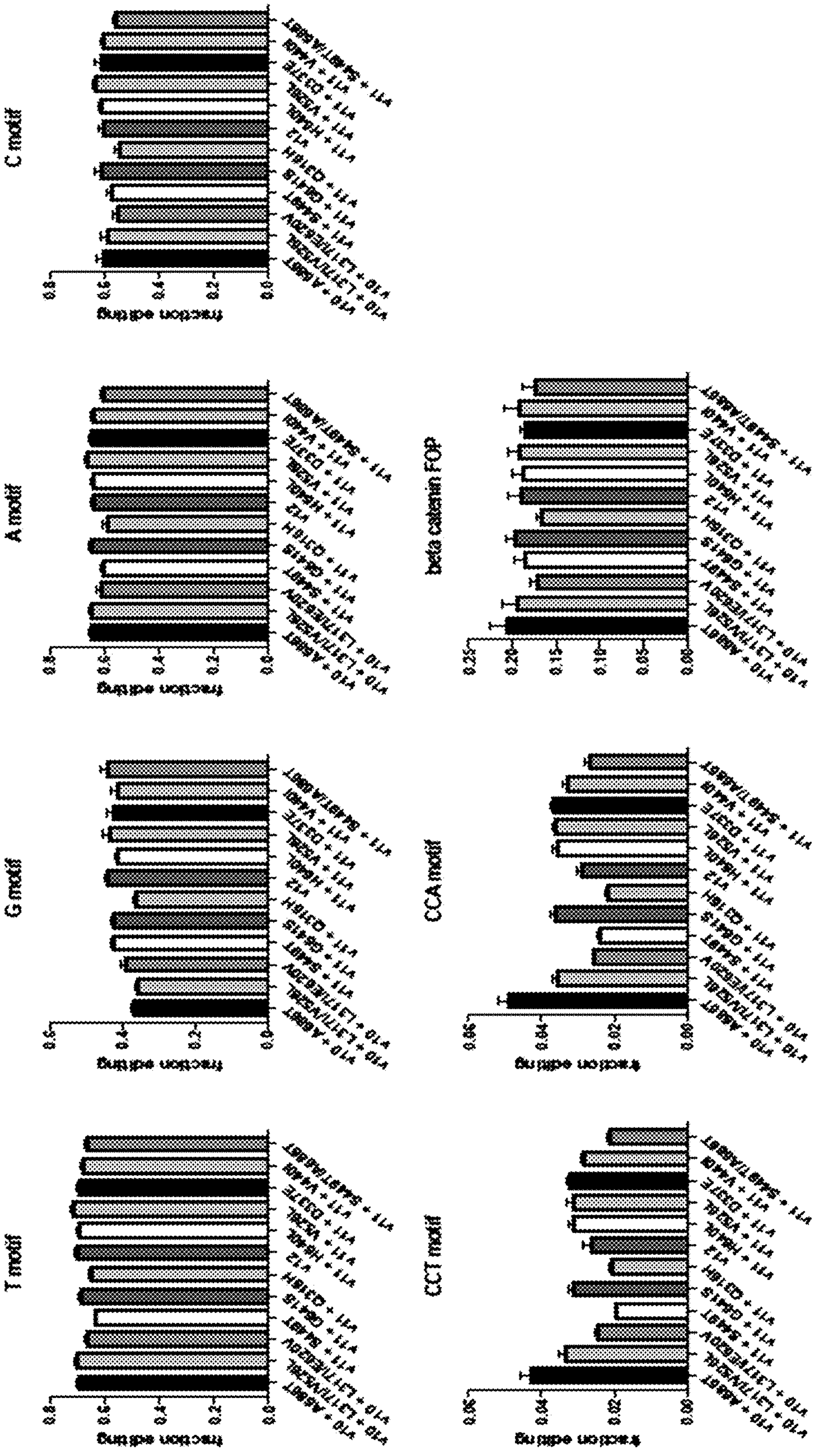
FIG. 66 show graphs illustrating results of RESCUE round 12.
Figure 67:
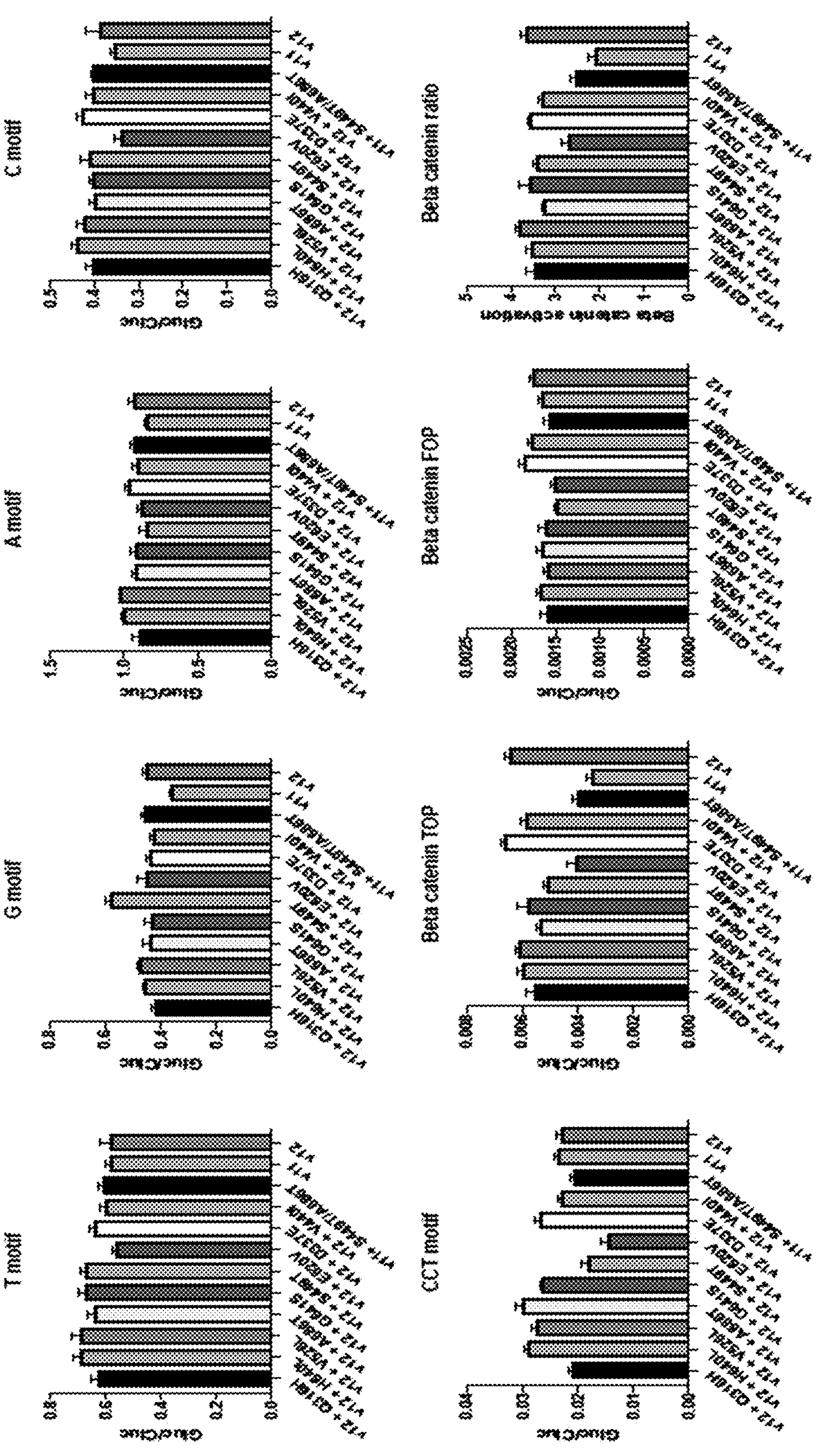
FIG. 67 show graphs illustrating results from a potential RESCUE round 13.
Figure 68:
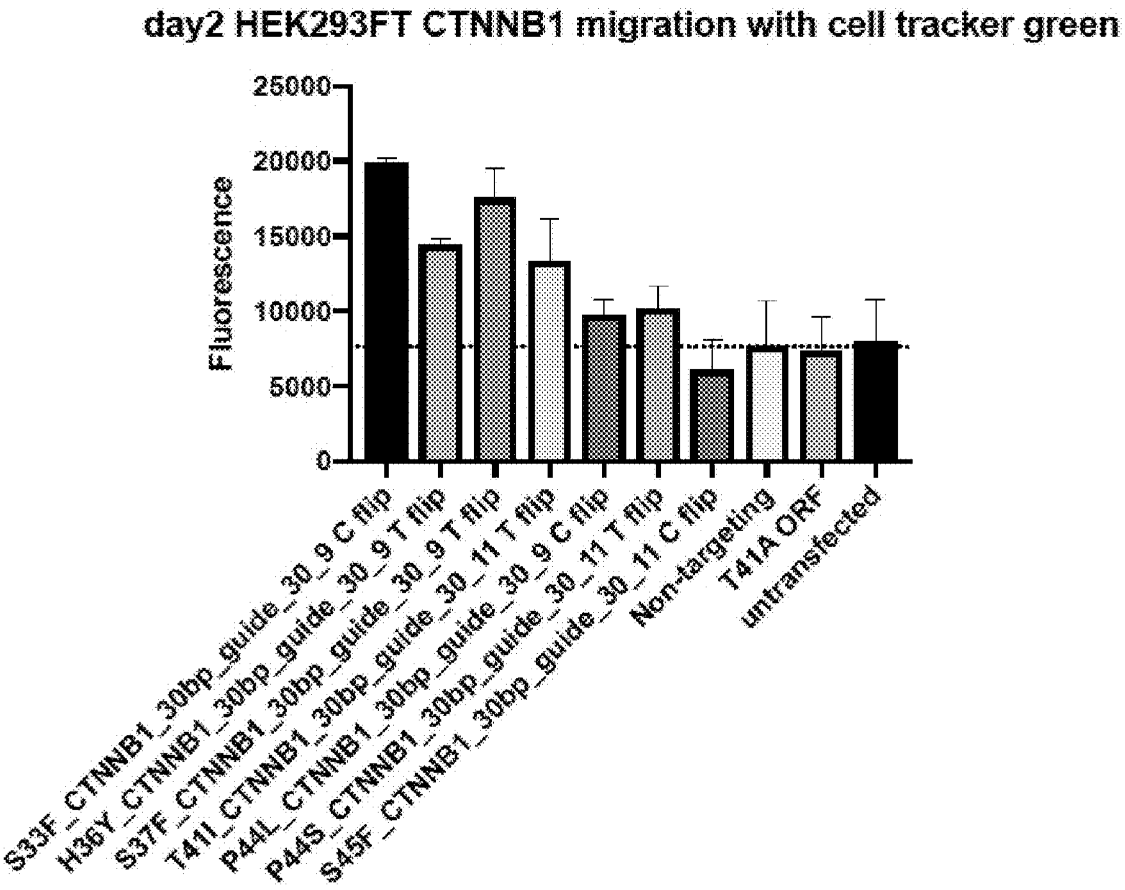
FIG. 68 is a graph showing results of a cell migration assay induced by beta catenin.

Alignments of Cas13b-t1, Cas13b-t2, and Cas13b-t3 with other Cas13b orthologs is shown in FIG. 56. In FIG. 56, Sequence #6 is Cas13b-t1, Sequence #1 is Cas13b-t2, and Sequence #2 is Cas13b-t3. Other sequences are Cas13b orthologs.

s 13b-t is similar to Cas13b from *Alistipes* sp. ZOR0009 (Cas13b4, NCBI™ accession WP_047447904). Human codon optimized proteins (codon optimization by GeneArt algorithm) synthesized by GenScript into pcDNA3.1(+) backbone for mammalian expression were used. Knockdown of *Gaussia* luciferase was tested in HEK293FT by two guide RNAs with non-targeting control. RanCas13b (B6) was used as a positive control. Luciferase values were normalized to non-targeting control—if no knockdown, value ~1. Some noise was noted in this measurement, so some values were slightly higher than 1 but in an acceptable margin to be attributable to noise. Gluc knockdown in mammalian cells by Cas13b-t1, Cas13b-t2, and Cas13b-t3 are shown in FIGS. 51-53, respectively. Guide RNA keys for Cas13b-t1, Cas13b-t2, and Cas13b-t3 are listed in Tables 15, 16, and 17, respectively.

TABLE 15

Guide RNA keys - Cas13b-t1

| Key # | Direct Repeat Sequence | DR is 5' or 3' to spacer sequence? |
|---|---|---|
| 1 | GCTGTAATCACCCCACAAATCGGAGGCTTCTTCAGC (SEQ ID NO: 278) | 3' |

TABLE 15-continued

Guide RNA keys - Cas13b-t1

| Key # | Direct Repeat Sequence | DR is 5' or 3' to spacer sequence? |
|---|---|---|
| 2 | GCTGTAATCACTCCACAAATCGGAGGCTTCTTCAGC (SEQ ID NO: 279) | 3' |
| 3 | GCTGAAGAAGCCTCCGATTTGTGGGGTGATTACAGC (SEQ ID NO: 280) | 3' |
| 4 | GCTGAAGAAGCCTCCGATTTGTGGAGTGATTACAGC (SEQ ID NO: 281) | 3' |
| 5 | GCTGTAATCACCCCACAAATCGGAGGCTTCTTCAGC (SEQ ID NO: 282) | 5' |
| 6 | GCTGTAATCACTCCACAAATCGGAGGCTTCTTCAGC (SEQ ID NO: 283) | 5' |
| 7 | GCTGAAGAAGCCTCCGATTTGTGGGGTGATTACAGC (SEQ ID NO: 284) | 5' |
| 8 | GCTGAAGAAGCCTCCGATTTGTGGAGTGATTACAGC (SEQ ID NO: 285) | 5' |

TABLE 16

Guide RNA key - Cas13b-t2

| Key # | Direct Repeat Sequence | DR is 5' or 3' to spacer sequence? |
|---|---|---|
| 1 | GCTGTAATCACCCCACAAATCGGGGGCTTCTCCAGC (SEQ ID NO: 286) | 3' |
| 2 | GCTGCAATCACCCCACAAATCGGGGGCTTCTCCAGC (SEQ ID NO: 287) | 3' |
| 3 | GCCGTAATCACCCCTCAAATCGGGGGCTTCTCCAGC (SEQ ID NO: 288) | 3' |
| 4 | GGTGTAATCACCCCACAAATCGGGGGCTTCTCCAGC (SEQ ID NO: 289) | 3' |
| 5 | GCTGGAGAAGCCCCCGATTTGTGGGGTGATTACAGC (SEQ ID NO: 290) | 3' |
| 6 | GCTGGAGAAGCCCCCGATTTGTGGGGTGATTGCAGC (SEQ ID NO: 291) | 3' |
| 7 | GCTGGAGAAGCCCCCGATTTGAGGGGTGATTACGGC (SEQ ID NO: 292) | 3' |
| 8 | GCTGGAGAAGCCCCCGATTTGTGGGGTGATTACACC (SEQ ID NO: 293) | 3' |
| 9 | GCTGTAATCACCCCACAAATCGGGGGCTTCTCCAGC (SEQ ID NO: 294) | 5' |
| 10 | GCTGCAATCACCCCACAAATCGGGGGCTTCTCCAGC (SEQ ID NO: 295) | 5' |
| 11 | GCCGTAATCACCCCTCAAATCGGGGGCTTCTCCAGC (SEQ ID NO: 296) | 5' |
| 12 | GGTGTAATCACCCCACAAATCGGGGGCTTCTCCAGC (SEQ ID NO: 297) | 5' |
| 13 | GCTGGAGAAGCCCCCGATTTGTGGGGTGATTACAGC (SEQ ID NO: 298) | 5' |
| 14 | GCTGGAGAAGCCCCCGATTTGTGGGGTGATTGCAGC (SEQ ID NO: 299) | 5' |
| 15 | GCTGGAGAAGCCCCCGATTTGAGGGGTGATTACGGC (SEQ ID NO: 300) | 5' |
| 16 | GCTGGAGAAGCCCCCGATTTGTGGGGTGATTACACC (SEQ ID NO: 301) | 5' |

TABLE 17

Guide RNA key - Cas13b-t3

| Key # | Direct Repeat Sequence | DR is 5' or 3' to spacer sequence? |
|---|---|---|
| 1 | GCTGTAATCACCCCACAAATCGGGGGCTGCTCCAGC (SEQ ID NO: 302) | 3' |
| 2 | GCTGGAGCAGCCCCCGATTTGTGGGGTGATTACAGC (SEQ ID NO: 303) | 3' |
| 3 | GCTGTAATCACCCCACAAATCGGGGGCTGCTCCAGC (SEQ ID NO: 304) | 5' |
| 4 | GCTGGAGCAGCCCCCGATTTGTGGGGTGATTACAGC (SEQ ID NO: 305) | 5' |

Example 11

This example summarizes the results of RESCUE rounds 1-12 (see FIGS. 57-68). Additional phenotypes tested included PCSK9, Stat3, IRS1, and TFEB. PCSK9 showed cloning improved the promoter. Stat3 showed ~10% editing on sites. Inhibition of signaling will be tested with a luciferase reporter. For IRS1, targeting of synthetic site will be tested before moving to pre-adipocyte cells. For TFEB, targeting may be designed to cause translocation of transcription factor→autophagy. In addition, a panel of 12 endogenous phosphosite targets and 48 synthetic targets will be tested. Screening in yeast will continue on VII background with S22P. Top hits were screened on V12 for V13 and new rounds of yeast hits will be evaluated. A few hundred additional screen hits on luciferase will be evaluated and Ade2 editing will be validated for specificity screening. Gene shuffling will also be tested for library complexity and different yeast reporters.

Example 12

This example lists further information and data related to Cas13b-t.

Knockdown of *Gaussia* luciferase in HEK293FT cells by two guide RNAs were tested. RanCas13b(B6) was used as a positive control. Luciferase values were normalized to non-targeting control. Some values were higher than 1 but in an acceptable margin to be attributable to noise. The value was about 1 if there was no knock down. The dead versions have both arginine and histidine residues in both identified HEPN domains mutated to alanine.

The spacer sequences used in the experiment are shown in Table 18 below.

TABLE 18

| Name | Spacer sequence |
|---|---|
| Guide 1 | GGGCATTGGCTTCCATCTCTTTGAGCACCT (SEQ ID NO: 306) |
| Guide 1 | GGAATGTCGACGATCGCCTCGCCTATGCCG (SEQ ID NO: 307) |
| Nontargeting | GTAATGCCTGGCTTGTCGACGCATAGTCTG (SEQ ID NO: 308) |

Figure 69:
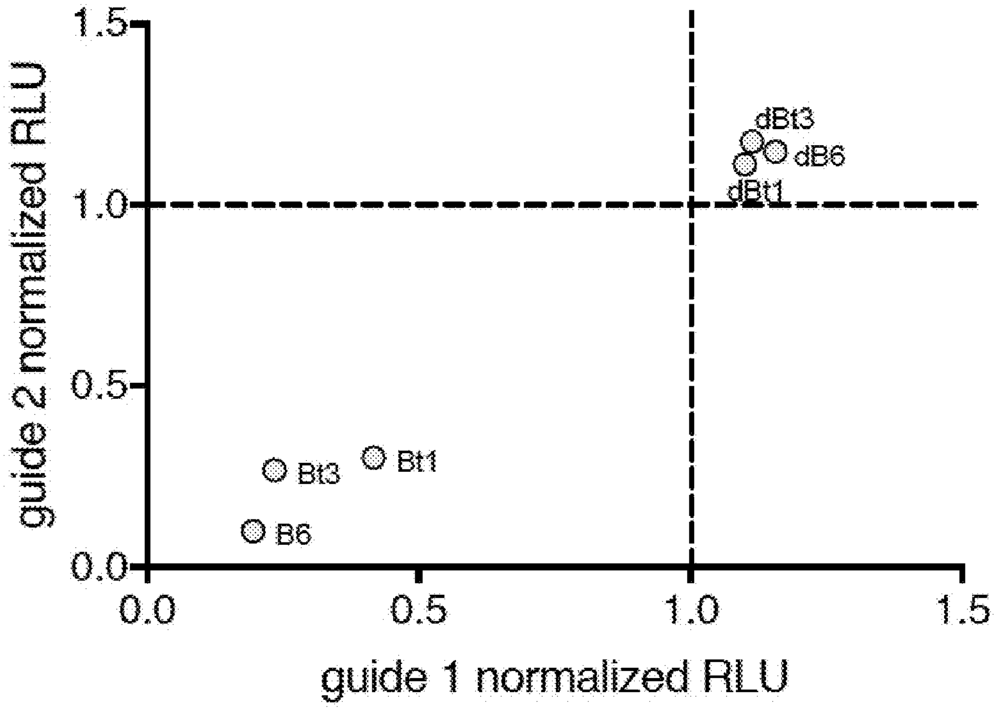
FIG. 69 shows a graph illustrating results of comparison of dead and live tiny orthologs for Gluc knock down.

Comparison of dead and live tiny orthologs for Gluc knock down is shown in FIG. 69.

Recovery of functional cypridina luciferase (W85X) by RNA editing was tested.

Mismatch distance indicated distance from 5' end of direct repeat to the A:C mismatch that specifics the desired editing site. Spacer sequences were all 30 bp unless otherwise indicated. B6 spacer was 30 bp and mismatch distance was 22. REPAIRv1, v2 spacer was 50 bp and mismatch distance was 34 (as published). The tiny ortholog constructs HIVNES-GS-dRanCas13bt-(GGS)2-huADAR2dd(E488Q).

Positive control constructs are as follows:

B6 construct: HIVNES-GS-dRanCas13b(B6)-(GGS)2-huADAR2dd(E488Q)

REPAIRv1 construct: dPspCas13b(B12)-GS-HIVNES-GS-huADAR2dd(E488Q)

REPAIRv2 construct: dPspCas13b(B12)-GS-HIVNES-GS-huADAR2dd(E488Q/T375G)

Figure 70:
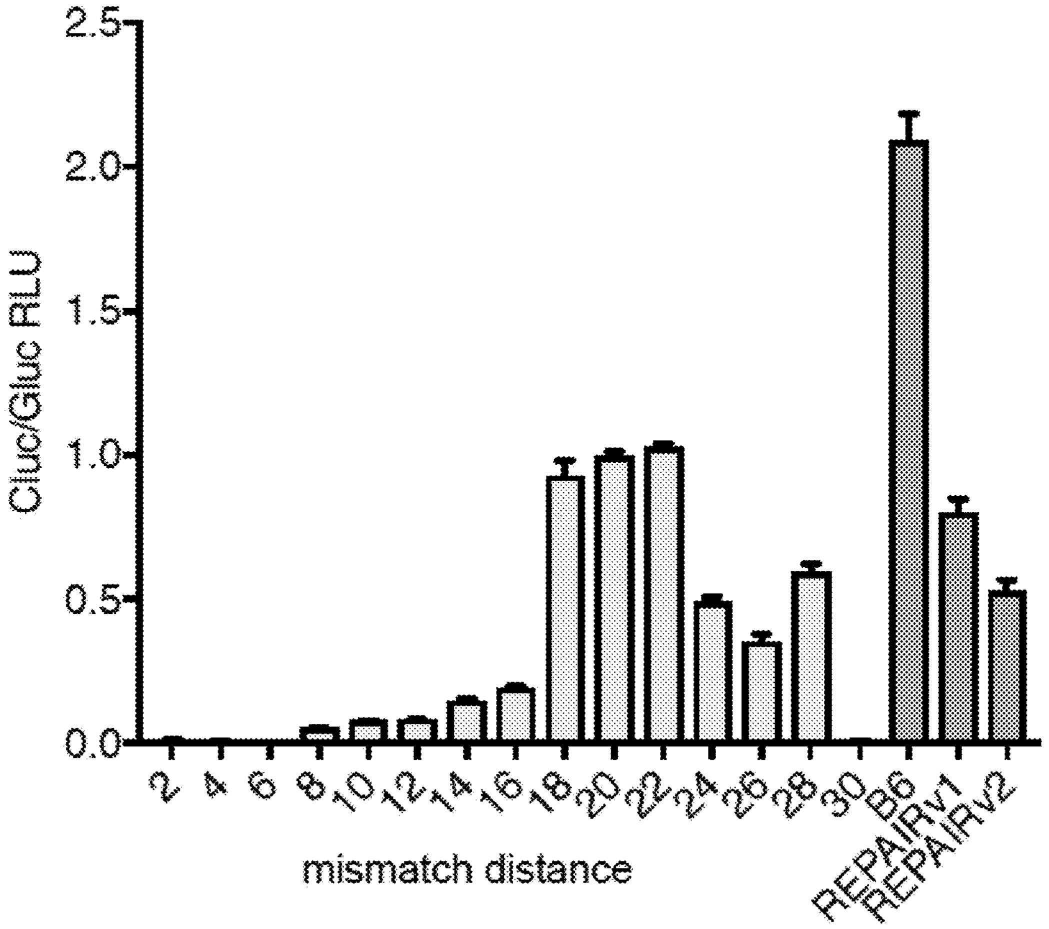
FIG. 70 shows a graph illustrating of testing function of Cas13b-t1.
Figure 71:
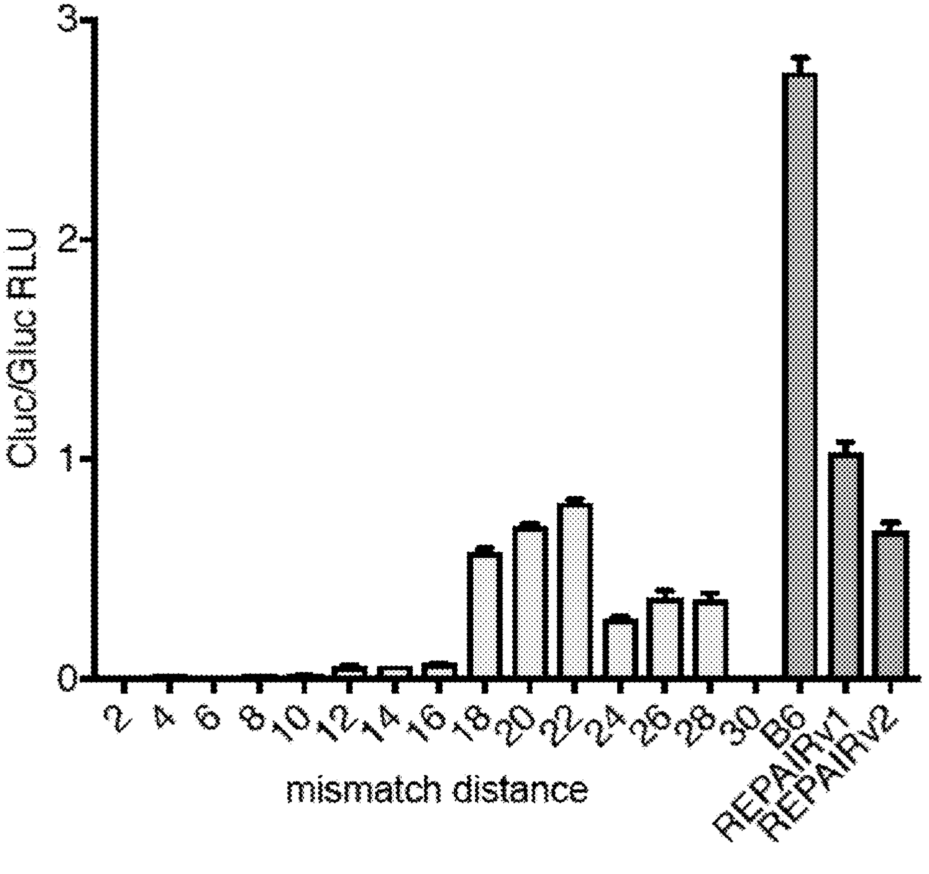
FIG. 71 shows a graph illustrating of testing function of Cas13b-t3.
Figure 72:
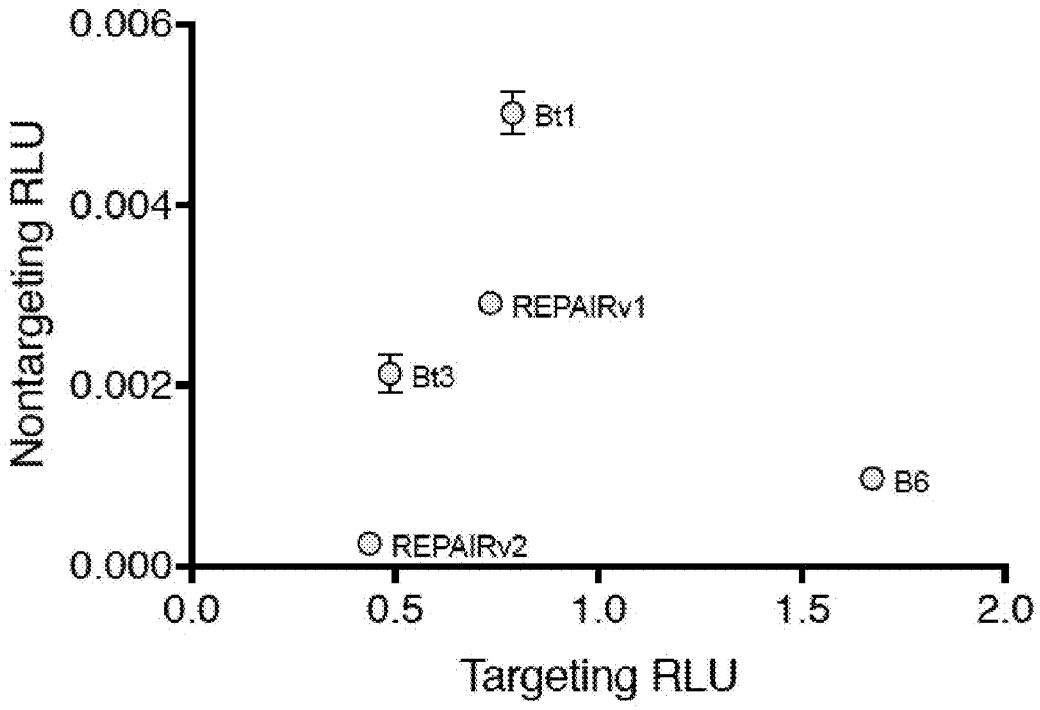
FIG. 72 shows a graph illustrating the guides, non-targeting comparison.

The data on Cas13b-t1 is shown in FIG. 70 and the data on Cas13b-t3 is shown in FIG. 71, respectively. The guides, non-targeting comparison is shown in FIG. 72. Whole transcriptome sequencing for detailed specificity and activity analysis can be performed.

Example 13

Programmable RNA editing offers an alternative to genome editing with benefits in safety and flexibility in targeting. An approach for RNA editing leveraging the Type VI programmable RNA-guided RNase CRISPR-Cas13, allows for specific adenosine to inosine conversion by guiding the adenosine deaminase activity of a fused ADAR2 to target transcripts. Here, Applicants expanded RNA editing capabilities to an additional base conversion by directly evolving ADAR2 to have cytidine deaminase activity, with a greater than 1,000 fold improvement in catalytic activity. The system, referred to as RNA Editing for Specific C to U Exchange (RESCUE), lacked strict sequence constraints, edited endogenous transcripts with high efficiency, and performed multiplexed C to U and A to I editing. Applicants performed additional rational mutagenesis to generate a highly specific variant of RESCUE, with greater than 10 fold reduction in A to I off-targets, which retained efficient C to U on-target activity. Applicants showed herein RESCUE's ability to alter phosphorylation signaling pathways in cells and modulate STAT activation and cellular growth. RESCUE expanded the RNA editing toolbox by enabling correction of additional mutations and modulation of more protein residues for broad applicability to biomedical research and therapeutics.

The programmable modification of nucleic acids in cells has numerous applications in basic research and therapeutics, especially in the treatment of genetic disease. DNA editing, typically through generation of double stranded breaks (DSB) to stimulate endogenous DNA repair pathways such as non-homologous end joining (NHEJ) or homology-directed repair (HDR), has become widely accessible with the development of tools based on CRISPR nucleases, including Cas9 and Cpf1/Cas12a. However, introduction of specific edits, including single base changes, relies on HDR and is inefficient in many cell types. Furthermore, the potential for off-target cleavage or DNA damage responses poses potential safety risks. DNA editors that circumvent DSB formations, such as base editors, provide a viable alternative, although they may be limited by sequencing constraints, such as the requirement for a protospacer adjacent motif (PAM) near the desired editing site and have significant off-targets. However, temporally controlled editing of nucleic acids through RNA base editing would avoid many of these issues and have many applications including modulation of cellular signaling, protein stability, or other post-translationally modified residues.

RNA base editing offers an alternative to DNA base editors, leveraging the adenosine deaminase acting on RNA (ADAR) family of enzymes to enact specific hydrolytic deamination of adenosine to inosine, a nucleobase that is functionally equivalent to guanosine in translation and splicing. Multiple RNA editing technologies have been developed that direct activity of ADAR or hyperactive variants to target transcripts, including RNA editing for programmable A to I (G) replacement (REPAIR), which uses the RNA-guided RNA targeting CRISPR enzyme Cas13. While these technologies can effectively convert A to I (G), other base changes remain inaccessible, preventing editing of diverse disease-associated mutations and functional residues involved in post-translational modifications. Cytidine to uridine editing via hydrolytic deamination activity would open up the targeting space and provide multiple new types of residue changes. However, many cytidine deaminases, such as the apolipoprotein B mRNA editing enzyme, catalytic polypeptide-like (APOBEC) family of enzymes, can only operate on single stranded substrates and will deaminate many of the cytosines in proximity of the APOBEC binding site.

Here, Applicants take advantage of features of adenosine deaminase, ADAR2. REPAIR, using ADAR2, allows for precise editing via formation of a double stranded RNA substrate using the guide RNA, which directs a hyperactive mutant of the human ADAR2 catalytic deaminase domain (ADAR2dd[E488Q]) activity to a single adenosine selected by an introduced mismatch. Applicants performed evolution of ADAR2dd for cytidine deamination to confer this level of precision to cytidine base conversion. Applicants used a combined rational mutagenesis and directed evolution scheme to iteratively boost the cytidine deamination activity of ADAR2dd more than 1,000-fold. This mutant ADAR2dd fused to Cas13b ortholog from *Riemerella anatipestifer* (RanCas13b) allowed for RNA Editing for Specific C to U Exchange (RESCUE) on both reporter and endogenous transcripts in mammalian cells. Lastly, Applicants improved the specificity of RESCUE more than 10-fold via rational mutagenesis and demonstrated phenotypic modulation of protein signaling and cell growth through C to U editing with RESCUE.

Figure 73A:
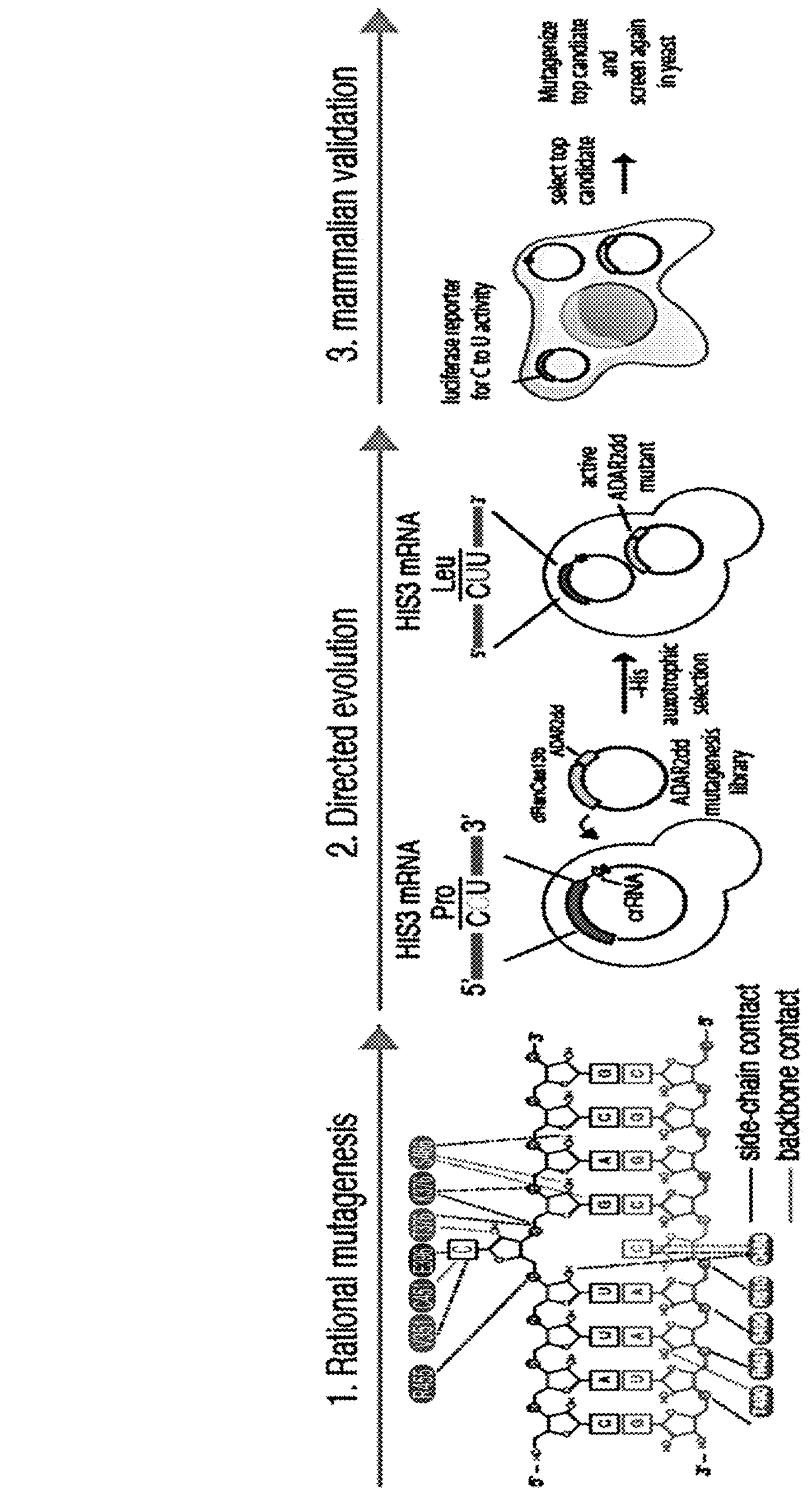
FIGS. 73A-73G: Directed evolution of a ADAR2 deaminase domain for cytidine deamination.
Figure 73B:
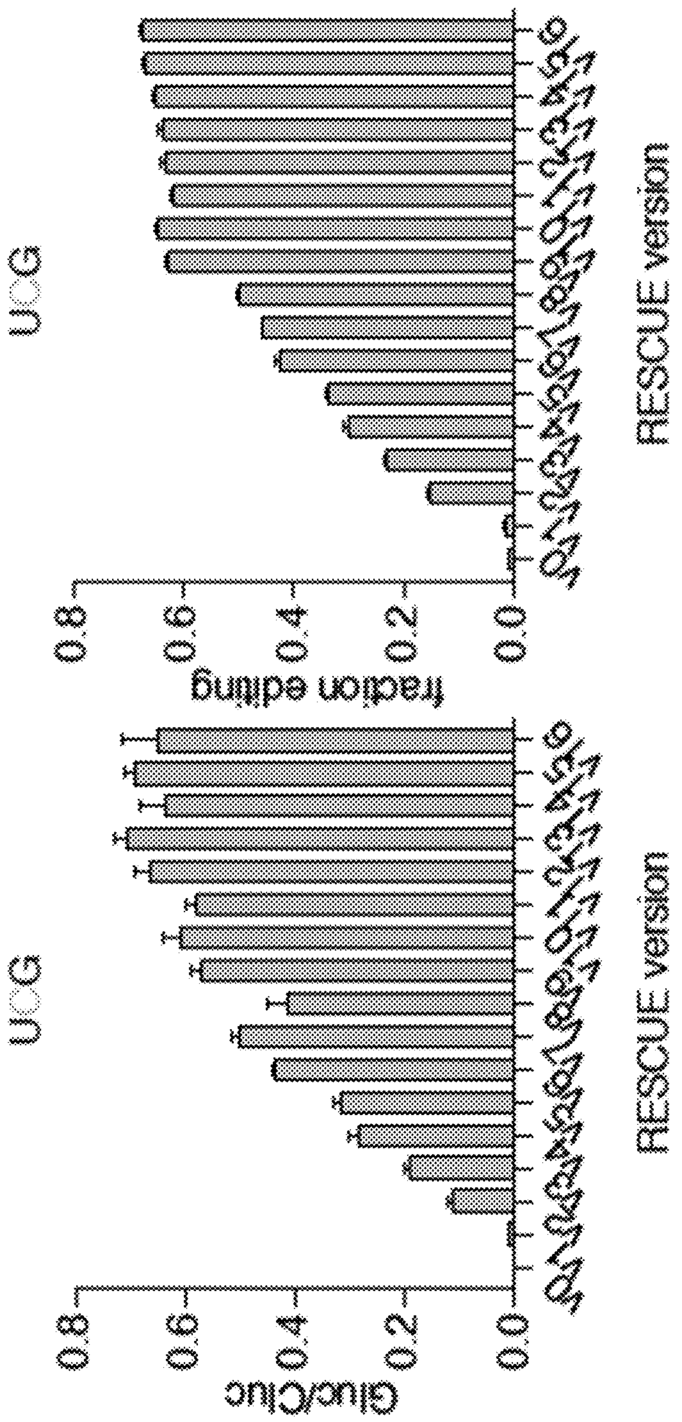
Figure 73C:
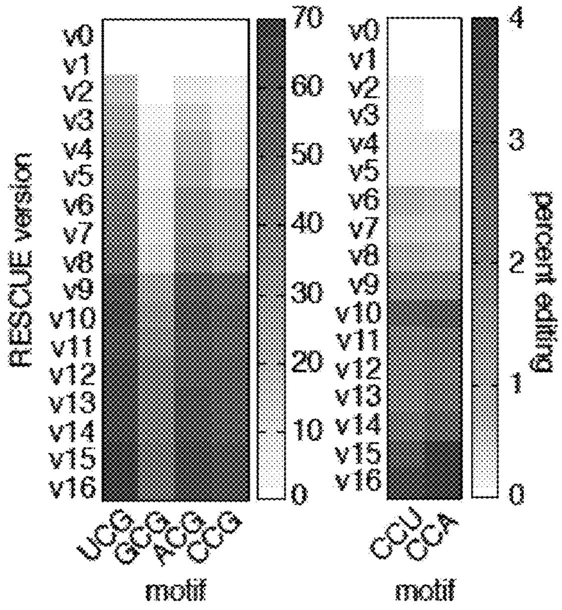
Figure 73D:
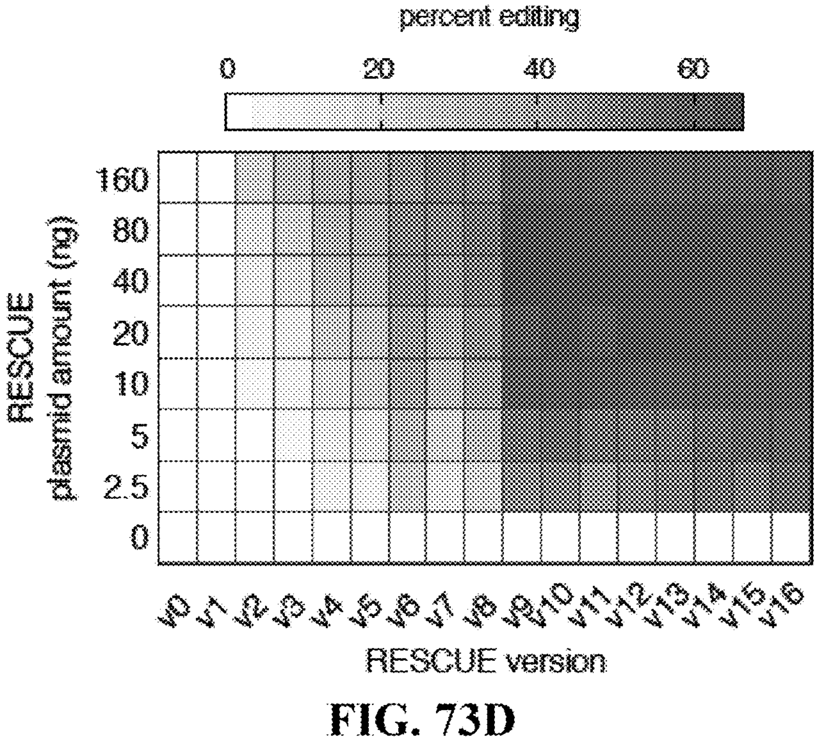
Figure 77A:
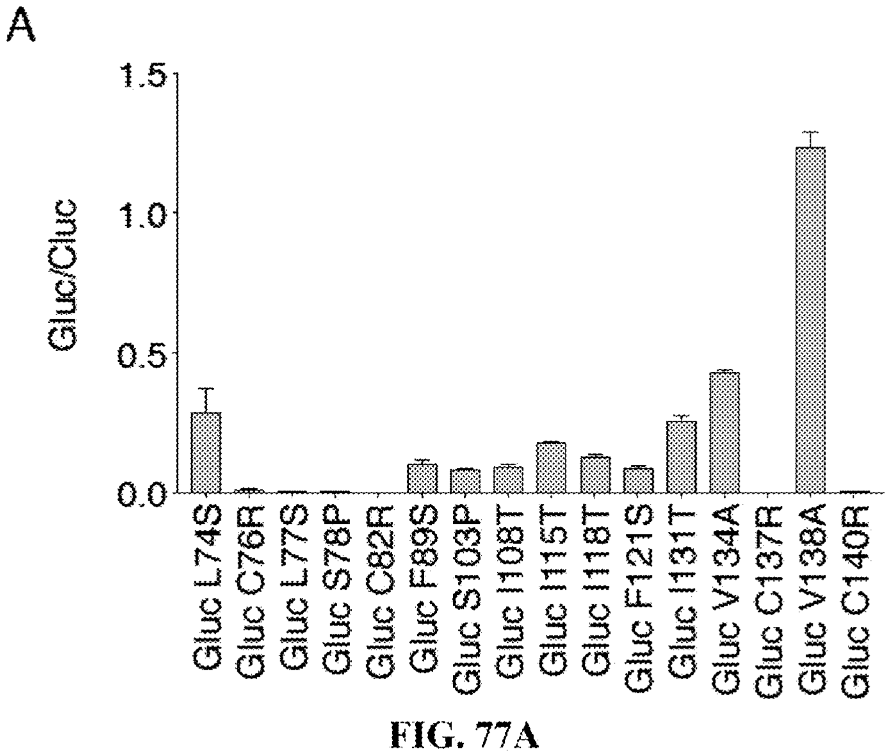
FIGS. 77A-77B: Screening of inactivating Gluc mutations for generating a cytosine deamination luciferase reporter.
Figure 77B:
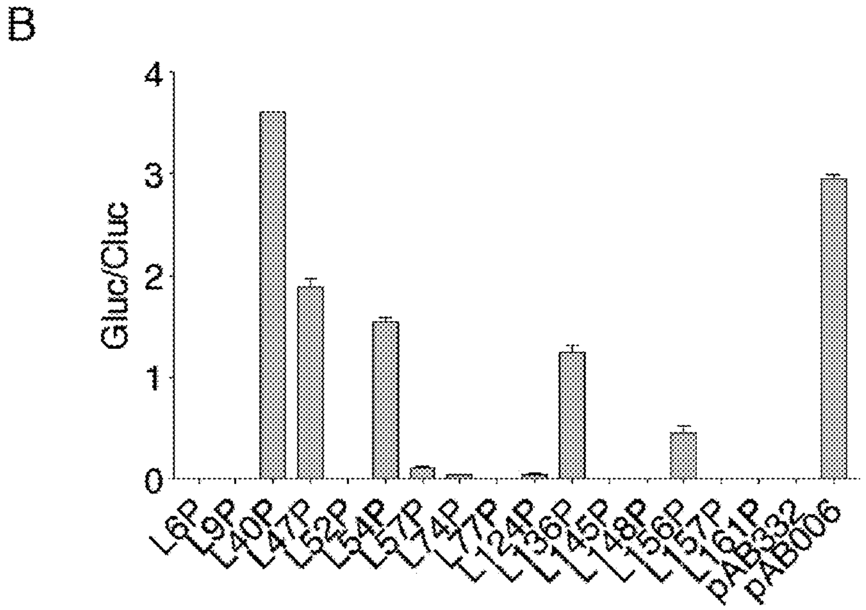
Figure 78:
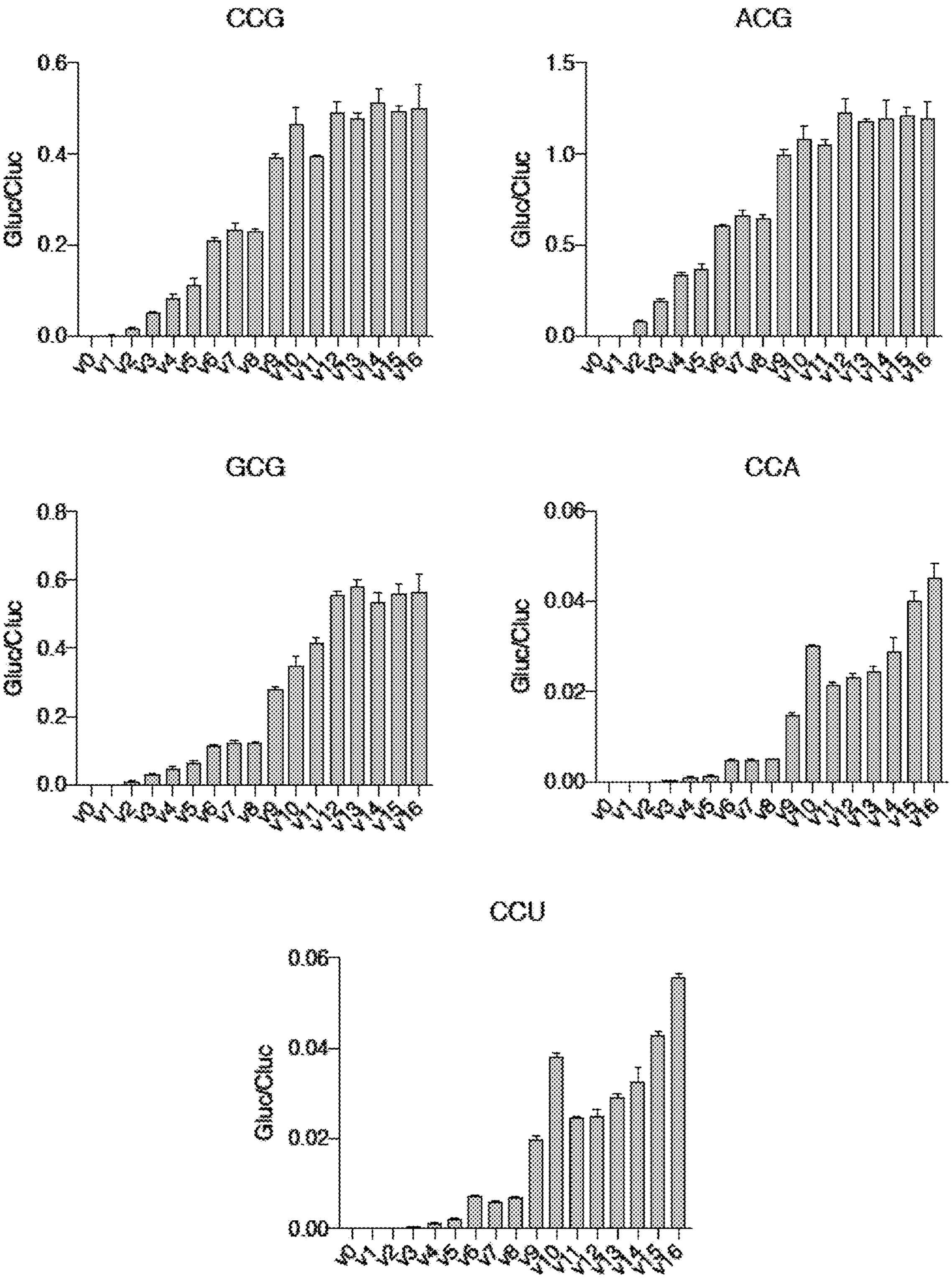
FIG. 78: Cytidine deamination activity of RESCUEv0-v16 on CCG, ACG, GCG, CCA, and CCU sites in Gluc. Values represent mean+/−S.E.M (n=3).
Figure 79A:
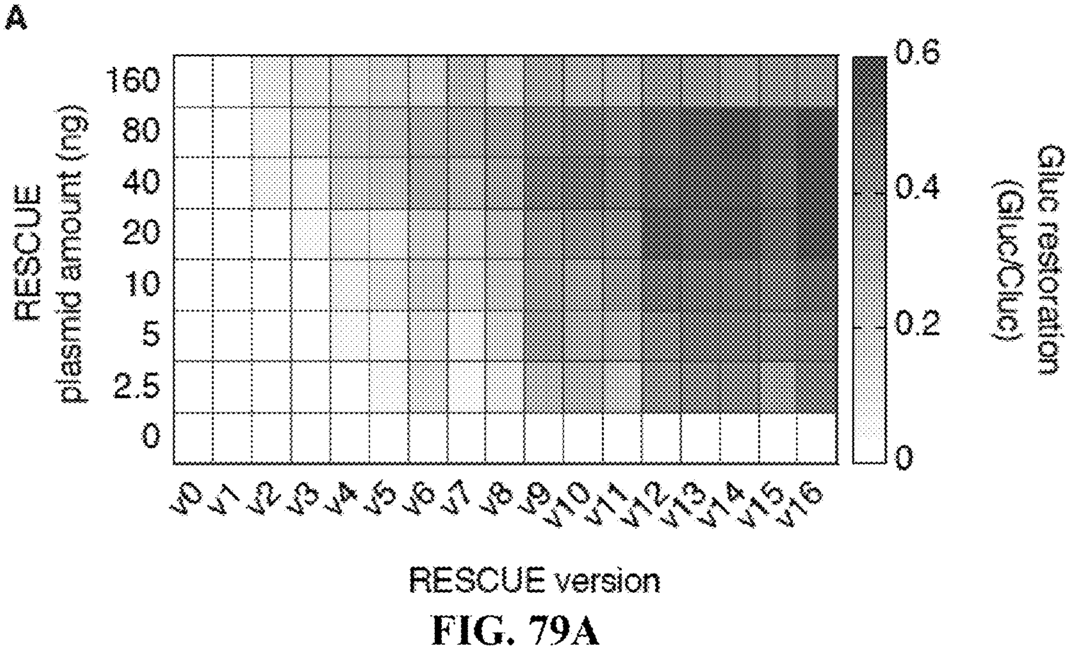
FIGS. 79A-79B: Cytidine deamination activity of varying amounts of RESCUEv0-16.
Figure 79B:
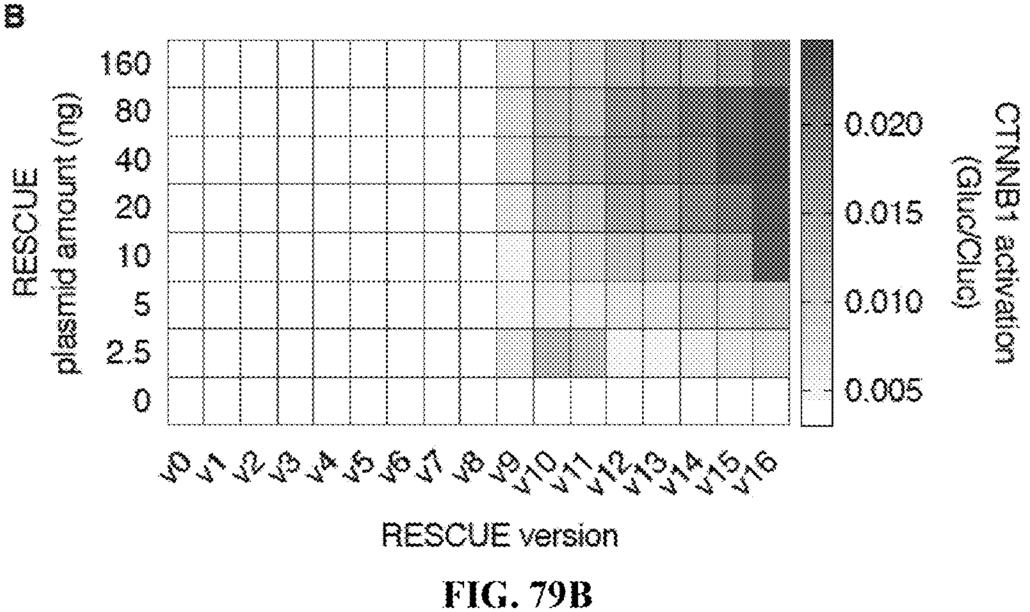
Figure 80:
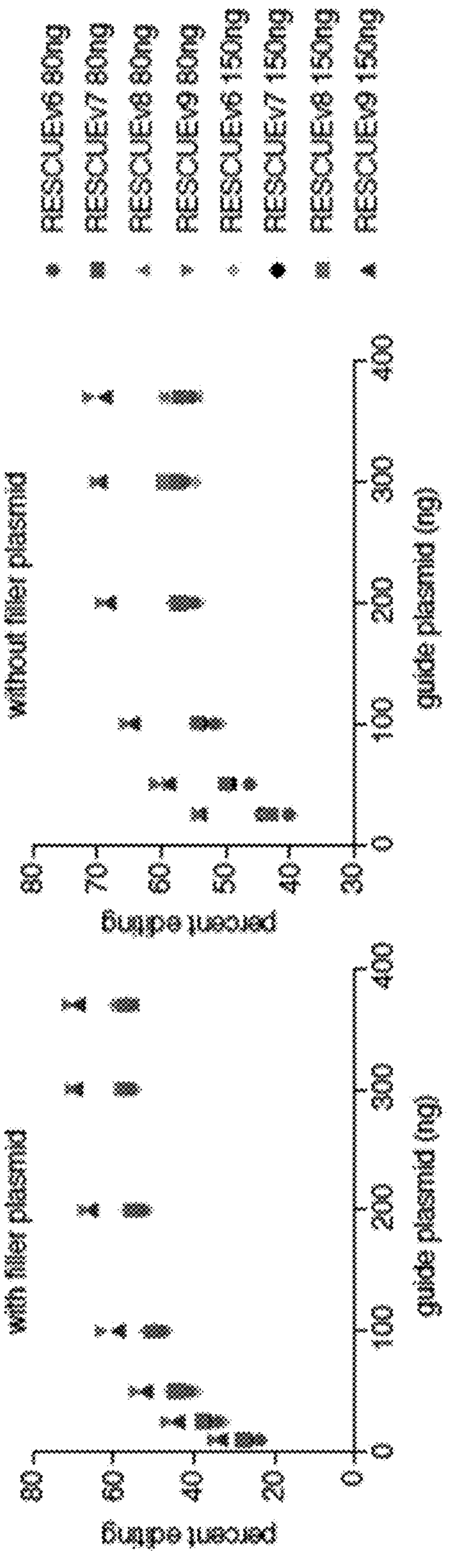
FIG. 80: Percent editing of a UCG site in the Gluc transcript by RESCUEv6-v9 at varying guide and RESCUE plasmid amounts. Values represent mean+/−S.E.M (n=3).

In order to generate a Cas13b guided-nucleoside deaminase capable of generating programmable C to U modifications, Applicants began a series of engineering steps on a RanCas13b-ADAR2dd fusion (FIGS. 73A-73G). The initial mutations were selected by saturation mutagenesis at residues involved in the binding of the targeted base. Mutants were evaluated for C to U editing and restoration of *Gaussia* luciferase (Gluc) mutant (C82R) catalytic activity (FIG. 77A). Three rounds of rational engineering produced a construct (RESCUEv3) with ~15% editing on the TCG motif (FIG. 73B). As the surrounding motif strongly determines RNA editing efficiency for A to I editing, Applicants tested for restoration of activity of luciferase mutants with all four possible 5' bases at the Gluc C82R site and two 3' motifs at the Gluc L77P mutation (FIG. 77B), finding modest increases in activity with these other motifs. To hasten further improvements, Applicants began directed evolution across the ADAR2dd protein to identify additional candidate mutations for increasing the activity of RESCUE.

To select for C to U activity, Applicants engineered a set of yeast reporter assays based on either restoration of GFP fluorescence or prototrophic reversion of a HIS auxotrophic selection gene (FIG. 73A, see table 19 for all screens and resulting mutations). With similar approaches, directed evolution of cytidine deaminase acting on RNA (CDAR) may also be performed.

TABLE 19

| RESCUE version number | Mutations | Screening method |
|---|---|---|
| RESCUEv0 | ADAR2 + E488Q | Hyper active variant from Kuttan and Bass |
| RESCUEv1 | v0 + V351G | Rational mutagenesis |
| RESCUEv2 | v1 + S486A | Rational mutagenesis |
| RESCUEv3 | v2 + T375S | Rational mutagenesis |
| RESCUEv4 | v3 + S370C | Y66H EGFP |
| RESCUEv5 | v4 + P462A | P196L HIS |
| RESCUEv6 | v5 + N597I | P196L HIS |

TABLE 19-continued

| RESCUE version number | Mutations | Screening method |
|---|---|---|
| RESCUEv7 | v6 + L332I | P196L HIS |
| RESCUEv8 | v7 + I398V | P196L HIS |
| RESCUEv9 | v8 + K350I | P196L HIS |
| RESCUEv10 | v9 + M383L | P196L HIS |
| RESCUEv11 | v10 + D619G | S22P HIS |
| RESCUEv12 | v11 + S582T | S22P HIS |
| RESCUEv13 | v12 + V440I | S22P HIS |
| RESCUEv14 | v13 + S495N | P196L HIS |
| RESCUEv15 | v14 + K418E | P196L HIS |
| RESCUEv16 | v15 + S661T | S22P HIS |

Figure 73E:
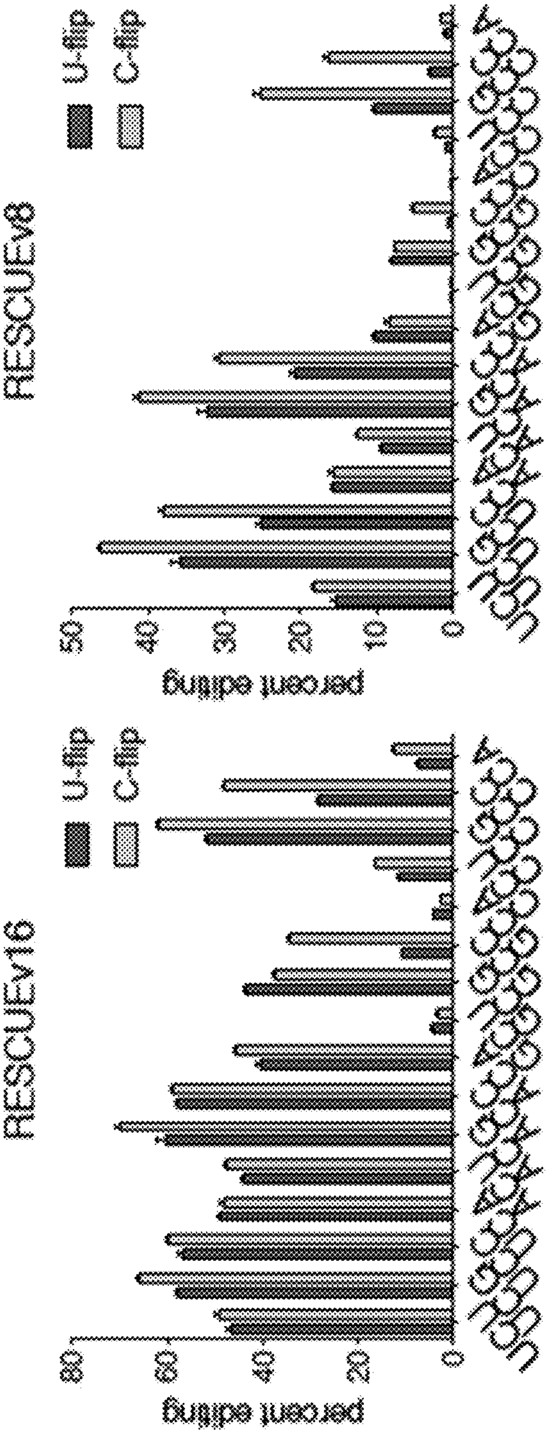
Figure 73F:
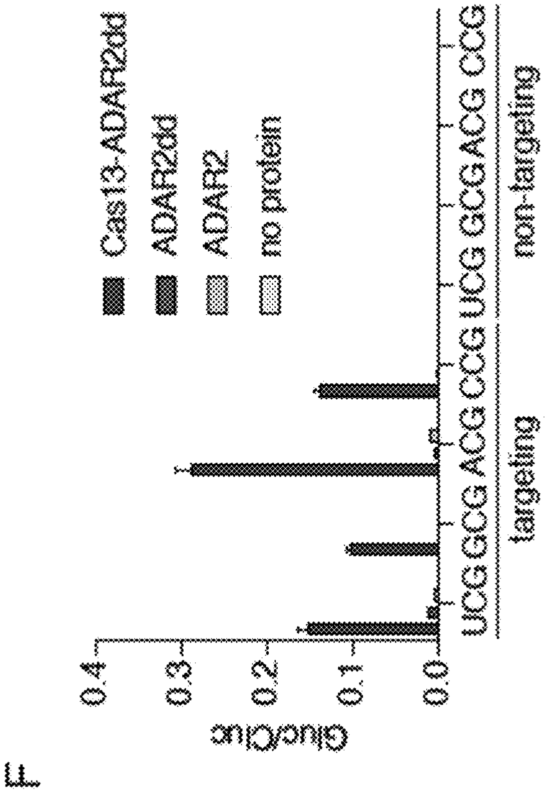
Figure 73G:
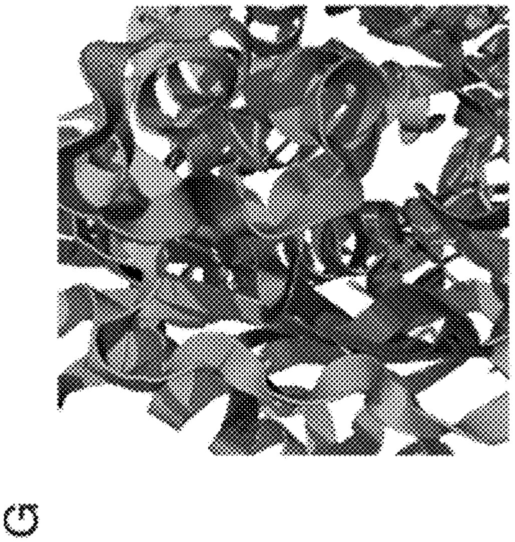
Figure 81:
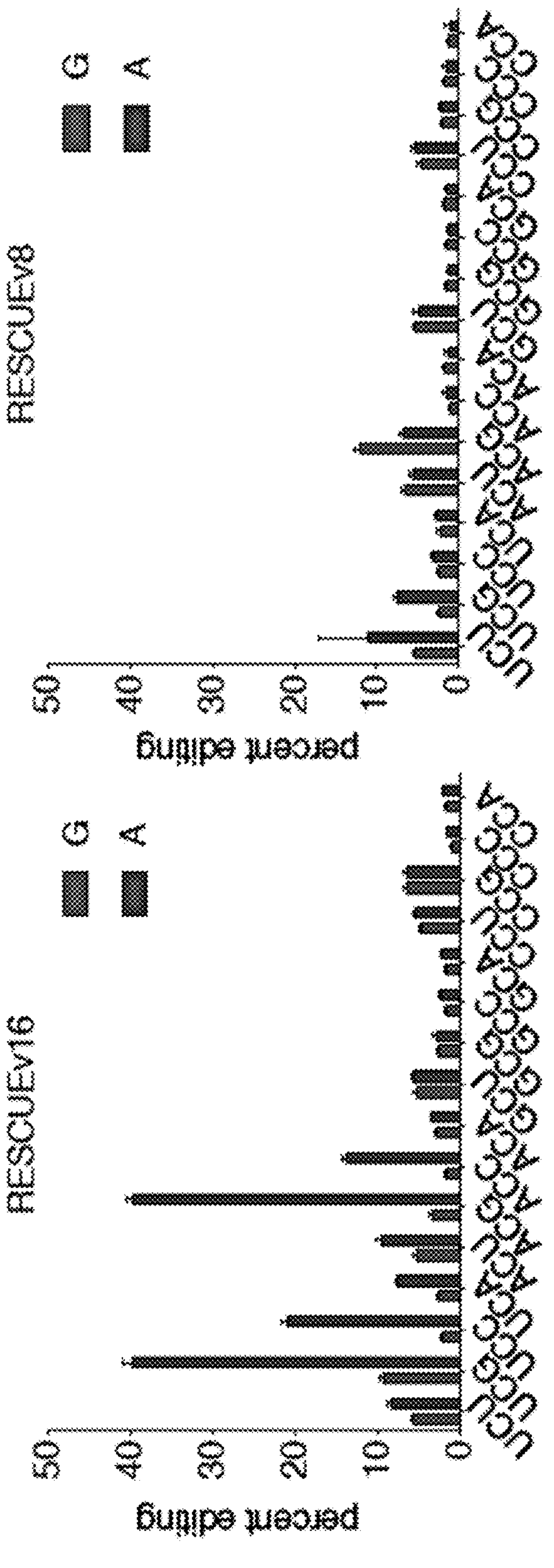
FIG. 81: Percent editing of Gluc sites with all 16 possible 5' and 3' base combinations with RESCUEv16 and v8 using guides with either G or A mismatches. Values represent mean+/−S.E.M (n=3).
Figure 82:
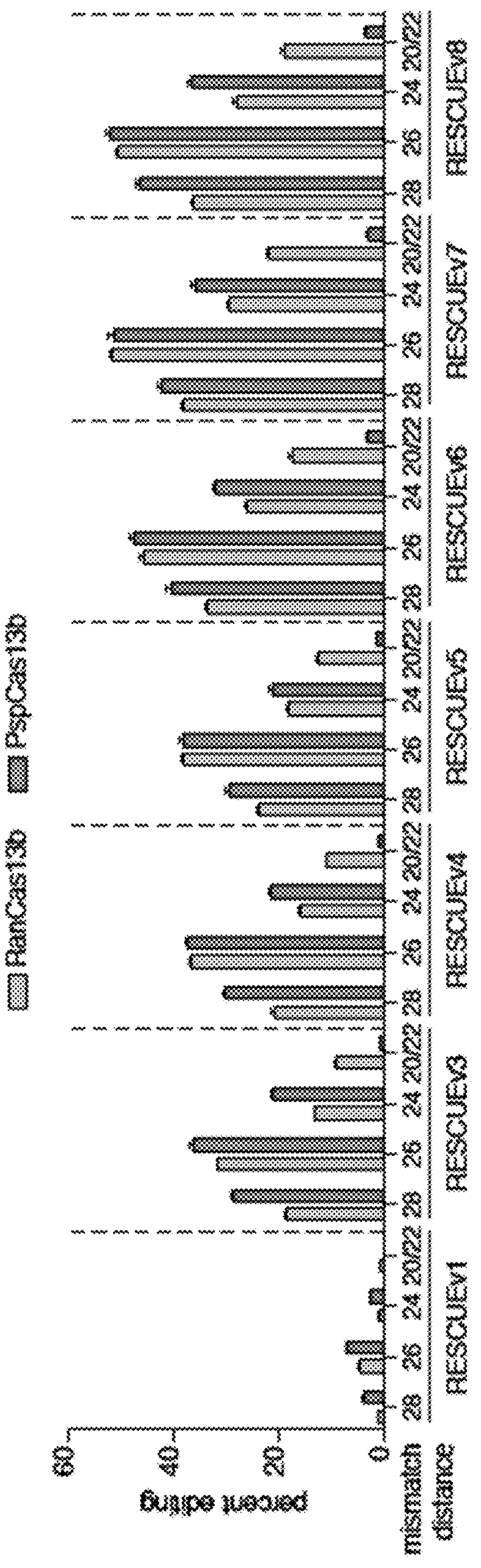
FIG. 82: Percent editing of RESCUEv1 and RESCUEv2-v8 on a UCG site in the Gluc transcript with guide RNAs of varying U mismatch positions. RESCUE versions are compared with both RanCas13b and PspCas13b. Values represent mean+/−S.E.M (n=3). 20/22 denotes 20 mismatch distance for RanCas13b and 22 mismatch distance for PspCas13b.
Figure 83:
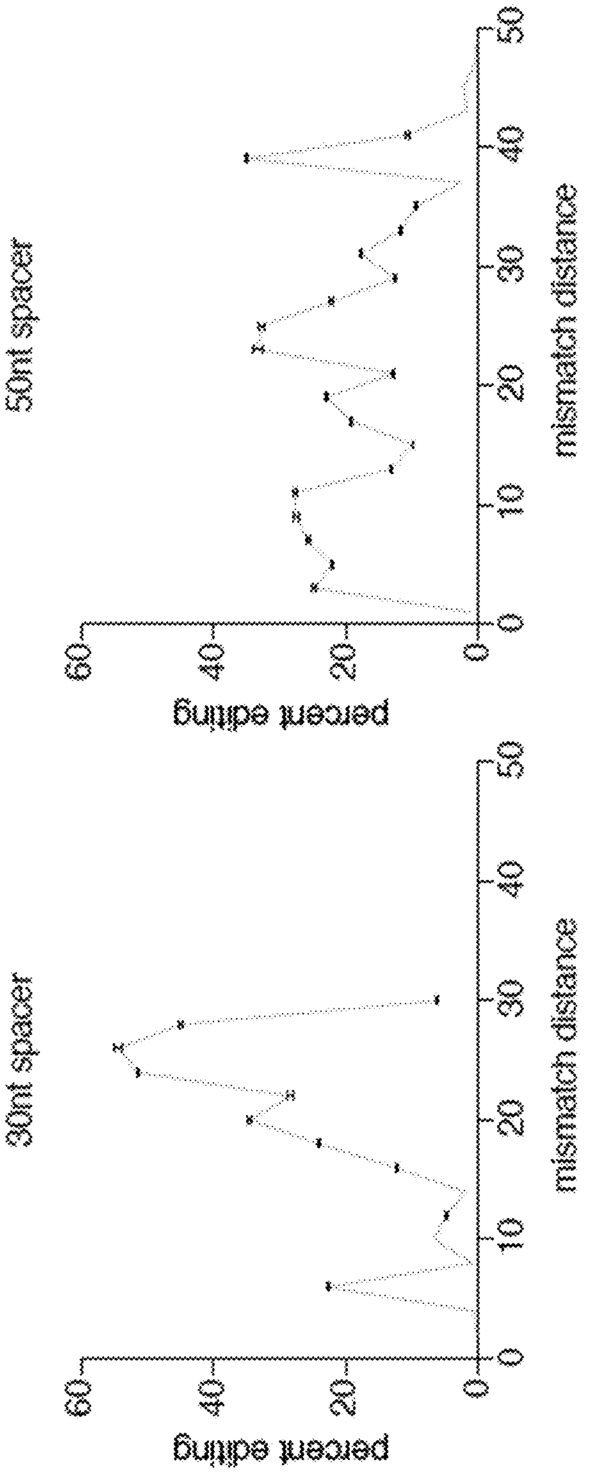
FIG. 83: Percent editing of RESCUEv16 on a UCG site in the Gluc transcript with 30 bp and 50 bp guides with varying U mismatch positions. Values represent mean+/−S.E.M (n=3).
Figure 84A:
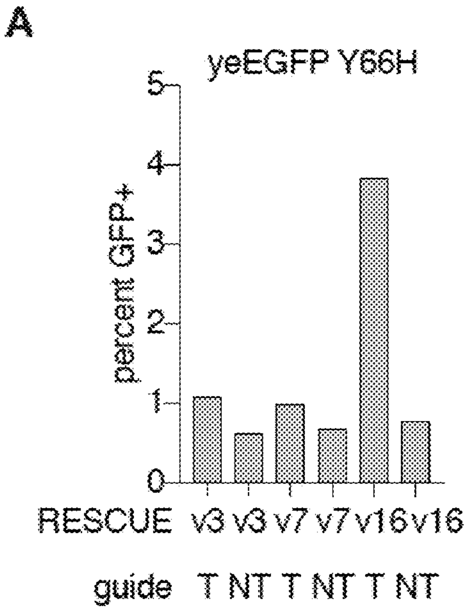
FIGS. 84A-84D: Editing rates of various yeast reporters for directed evolution.
Figure 84B:
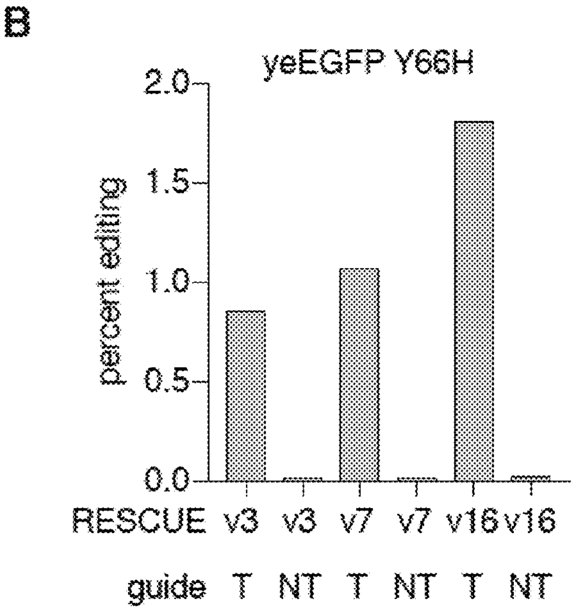
Figure 84C:
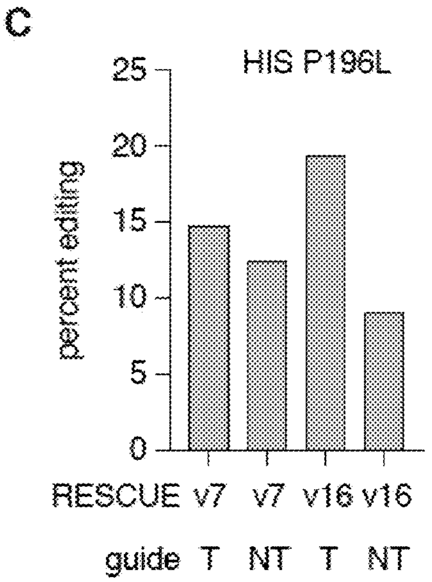
Figure 84D:
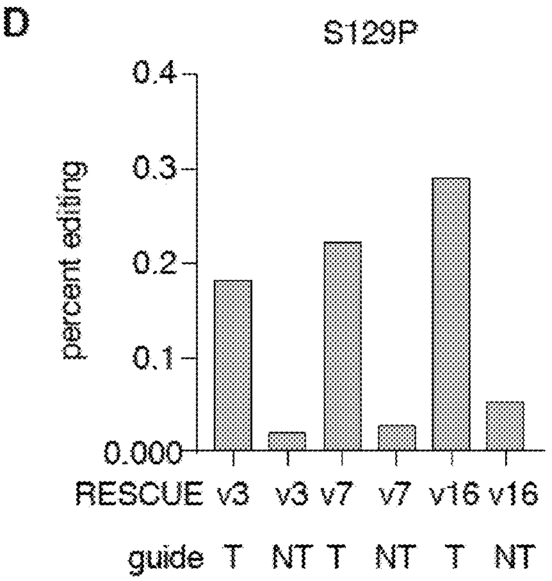

Sequencing FACS-sorted cultures or surviving colonies, for GFP and His restoration respectively, elected individual mutations in the ADAR2dd domain, which were introduced onto the previous RESCUE version and evaluated for activity in mammalian cells on luciferase or CTNNB1 editing reporter constructs. These rounds of evolution, culminating with the final construct RESCUEv16, resulted in a steady increase in activity across all six motifs tested and reduced the RESCUE and guide plasmid doses required to edit and restored luciferase activity. (FIGS. 73C, 73D, 78, 79A-79B, 80). Additionally, RESCUEv16 achieved higher than 20 percent editing on 12 out of 16 possible motif combinations of the direct 5' and 3'bases with optimal base flips of either C or U (FIGS. 73E and 81). Applicants compared our RESCUE versions with fusions of PspCas13b and RanCas13b, and found them to be equivalently active (FIG. 82). While REPAIR uses 50 nt guides, RESCUEv16 edited the TCG construct optimally with a 30 nt guide RNA with the targeting base-flip 26 base pairs from the 5' end of the target (FIG. 83).

Figure 85A:
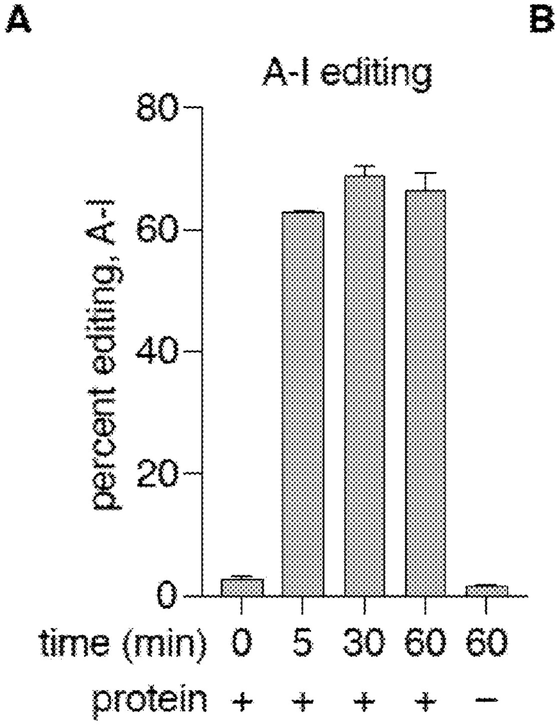
FIGS. 85A-85B: Biochemical deamination activity of ADAR2 deaminase domain containing RESCUEv2 mutations using recombinant protein.
Figure 85B:
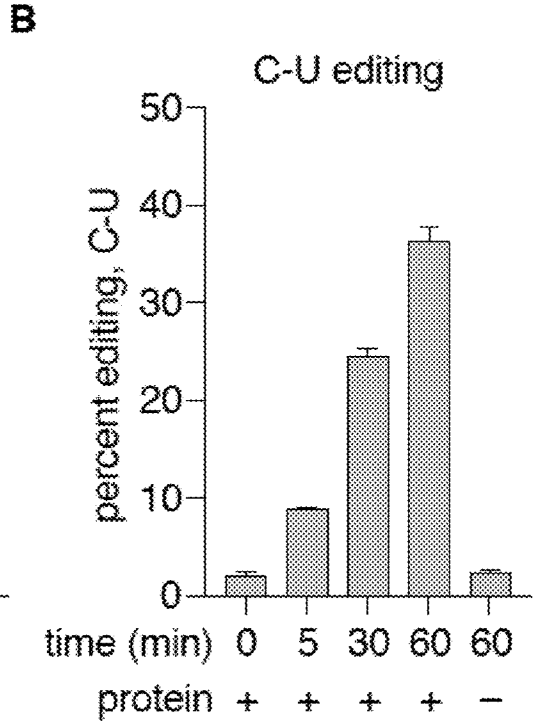

To validate the improvements from the directed evolution pipeline in the yeast system, Applicants tested multiple RESCUE iterations for both activity in yeast and biochemically. Testing both EGFP and His restoration in yeast, Applicants found that later versions of RESCUE more effectively performed C to U editing on both targets (FIGS. 84A-84D). Biochemical characterization of RESCUE constructs introduced into purified hADAR2dd protein revealed that RESCUE mutations improved the kinetics of C to U editing on substrates in vitro (FIGS. 85A-85B).

Figure 86A:
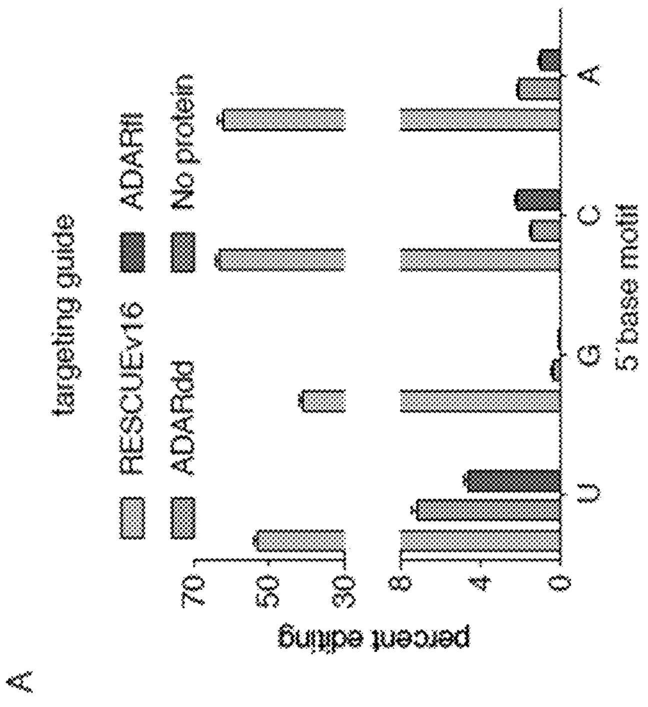
FIGS. 86A-86E: Comparison of cytidine deaminase activity of RESCUEv16, full ADAR2 (with RESCUEv16 mutations), ADAR2 deaminase domain (with RESCUEv16 mutations), and without any protein.
Figure 86B:
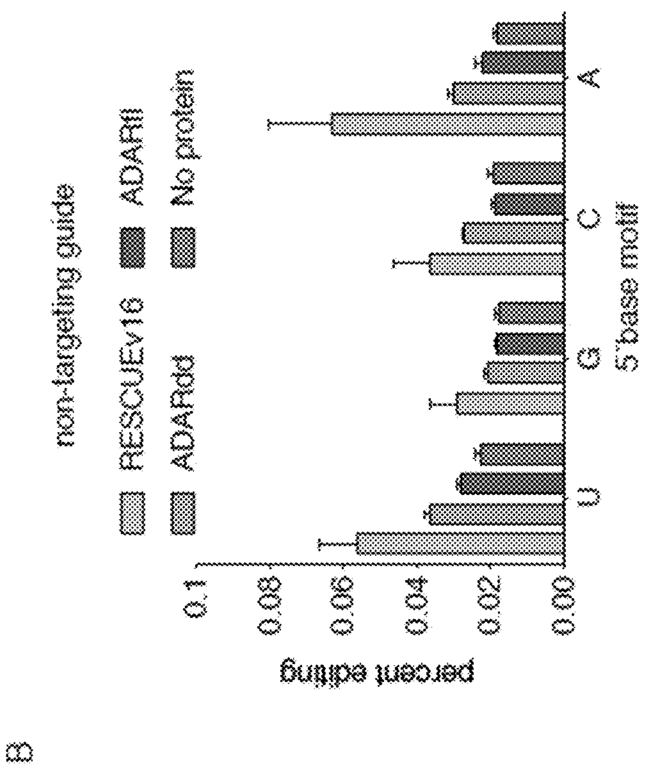
Figure 86C:
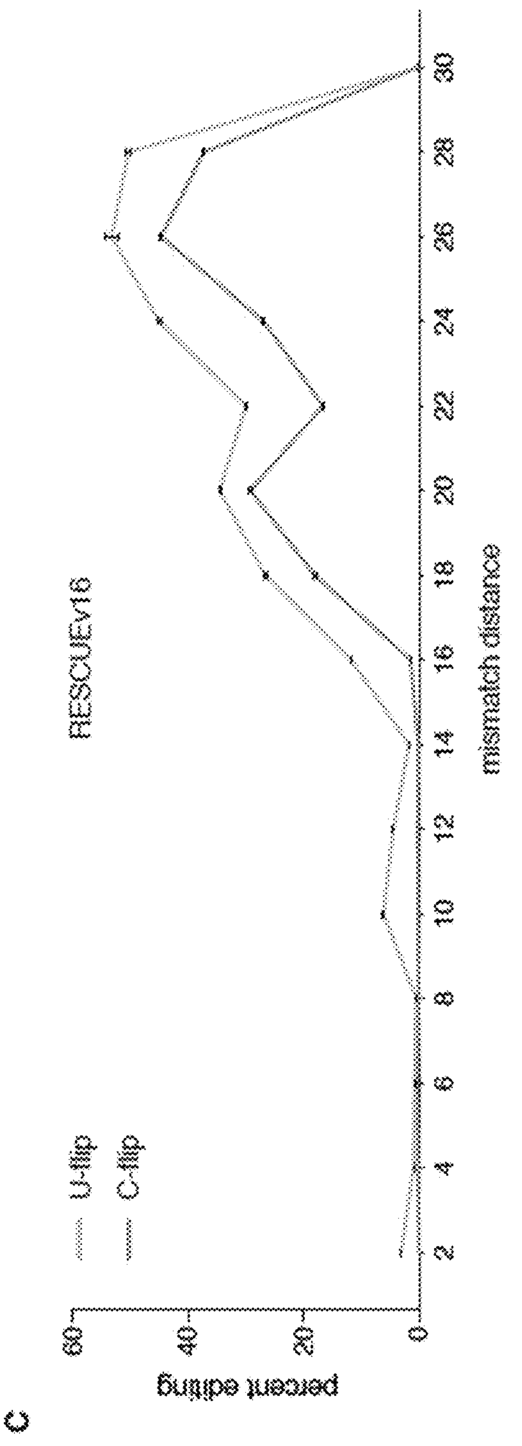
Figure 86D:
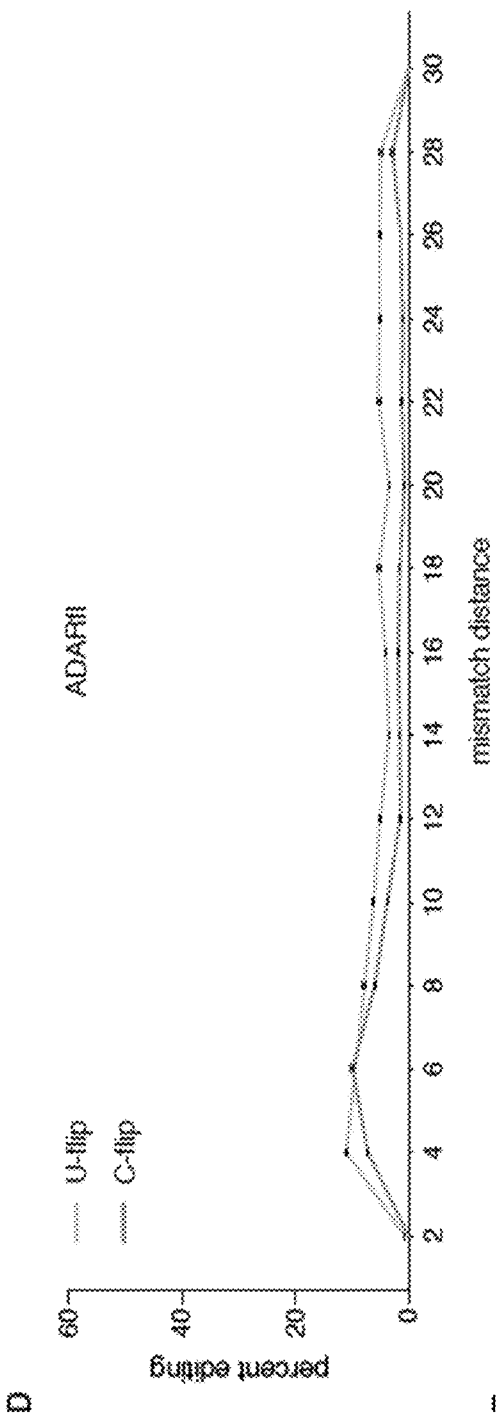
Figure 86E:
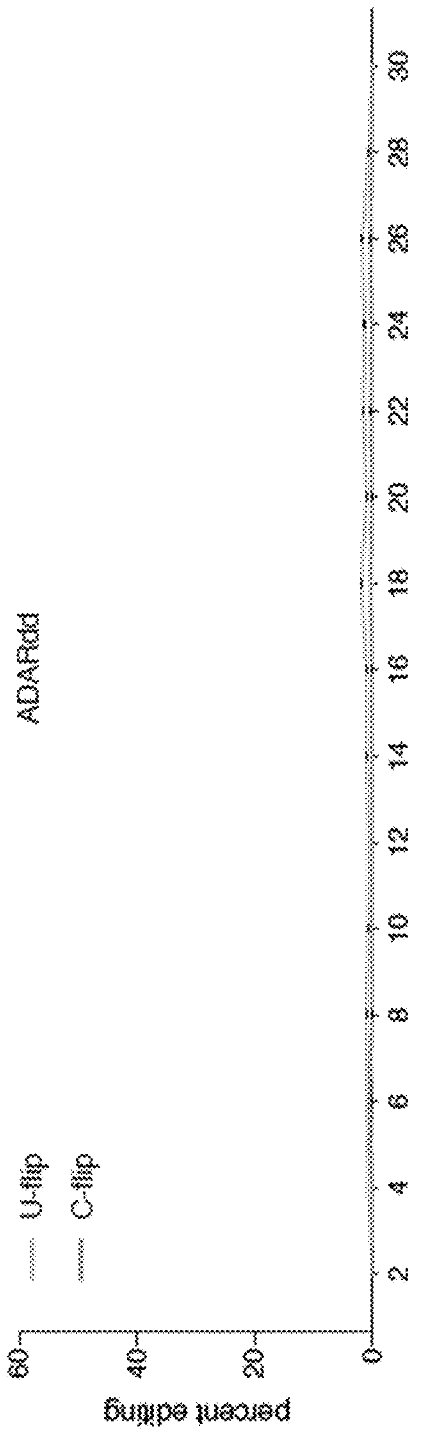
Figure 87A:
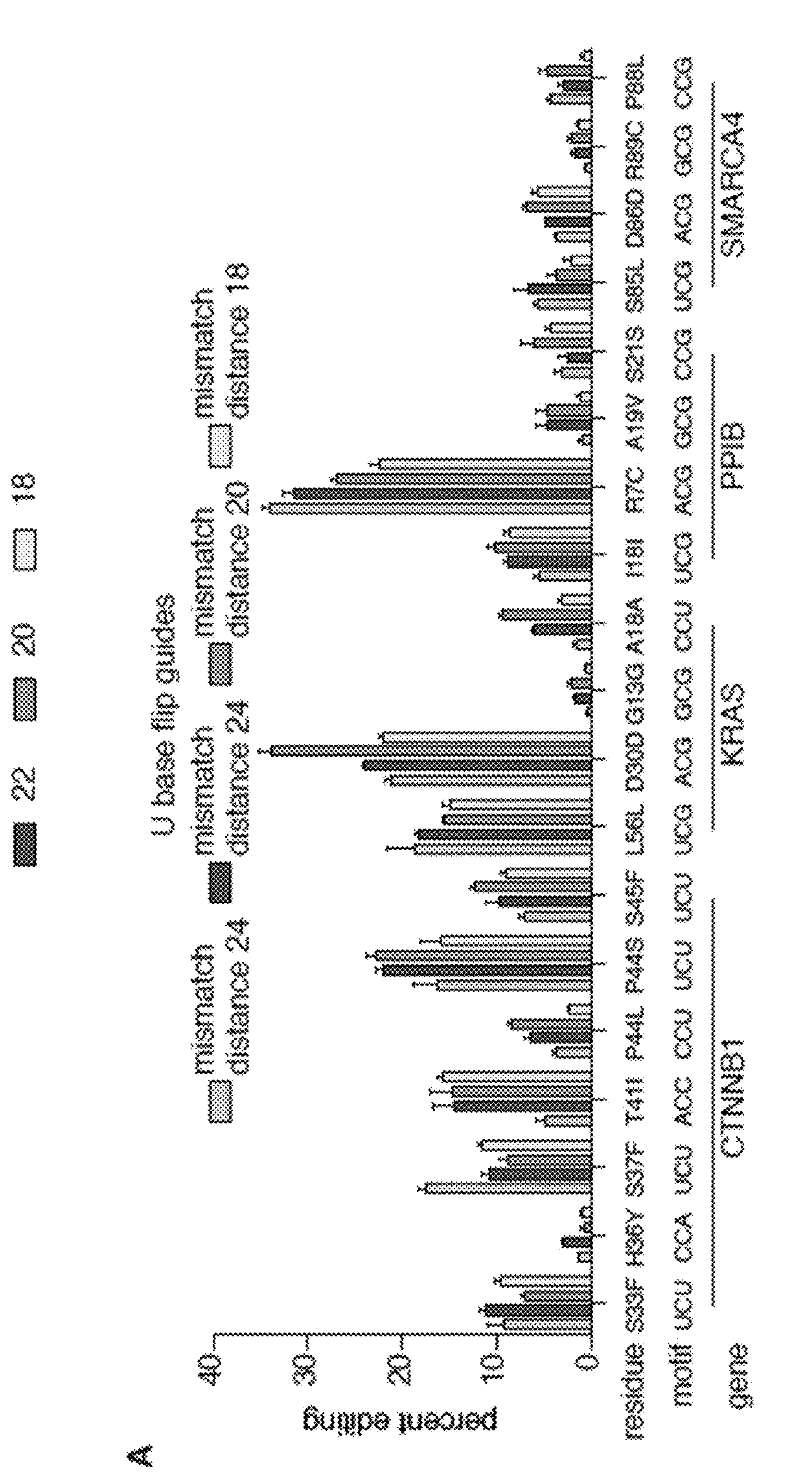
FIGS. 87A-87C: Mismatch position tiling to find optimal editing guide design for RESCUEv16 on endogenous target sites.
Figure 87B:
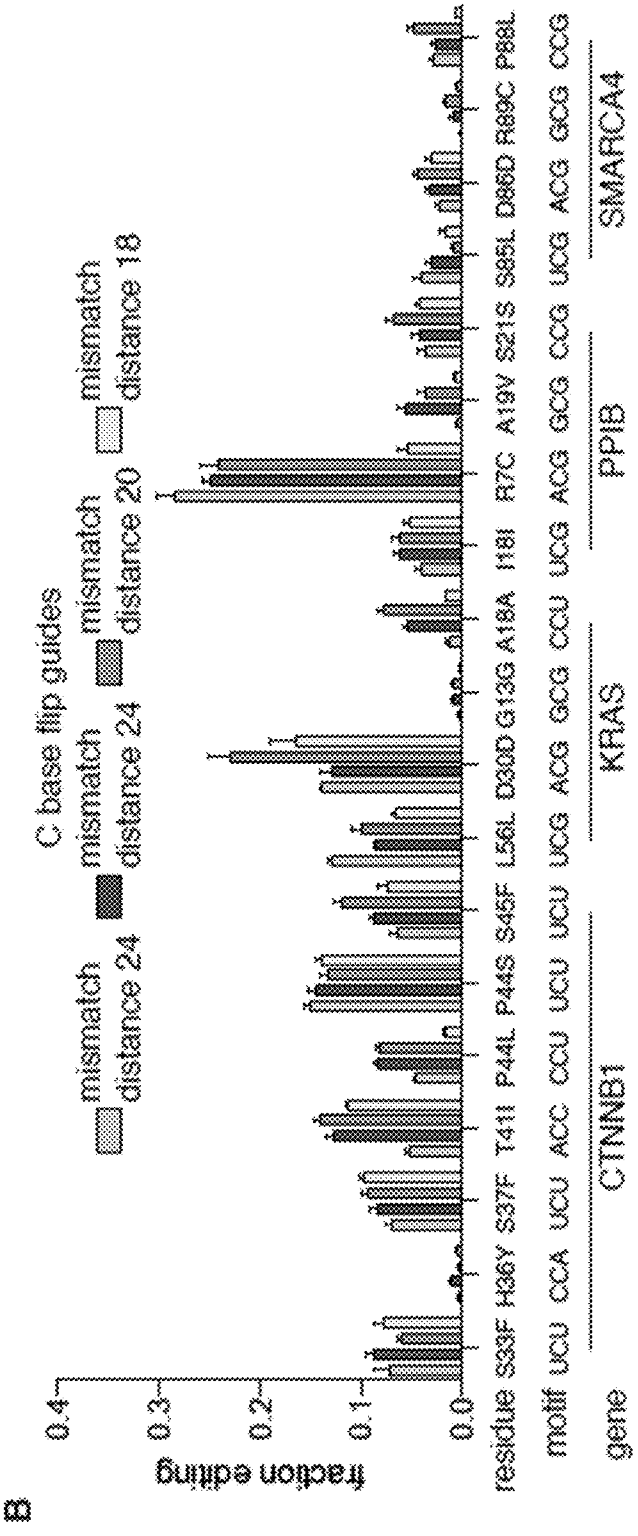
Figure 87C:
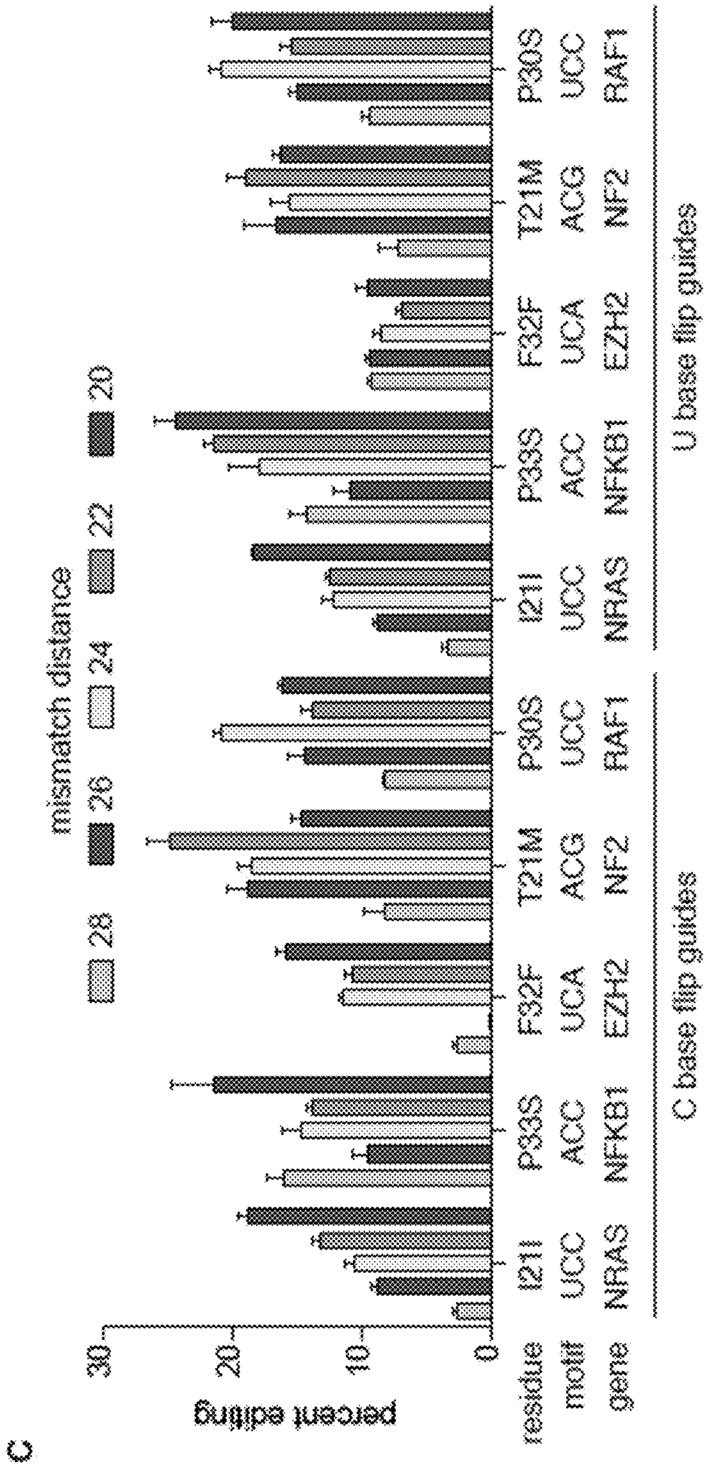

Further, Applicants assayed C to U activity in the absence of a Cas13b construct. Applicants introduced the RESCUEv16 mutations into both the ADAR2 deaminase domain or the full length ADAR2 protein. Applicants found that editing and restoration of luciferase activity was significantly higher on all 5' motifs for the complete RESCUEv16 construct when compared to ADARdd, full length ADAR, or the absence of protein (FIGS. 73F and 86A), and that, while certain guide positions achieved editing of almost 20% with full length ADAR (FIGS. 86B-86D), maximal efficiency was markedly reduced compared to RESCUE, establishing that the RanCas13b fusion was necessary for its function. The position of the 16 mutations in RESCUEv16 place them throughout the structure of ADAR2dd (FIG. 73G), indicating both direct interactions of the introduced residues with the catalytic pocket, as well as long-range allosteric effects.

Figure 88:
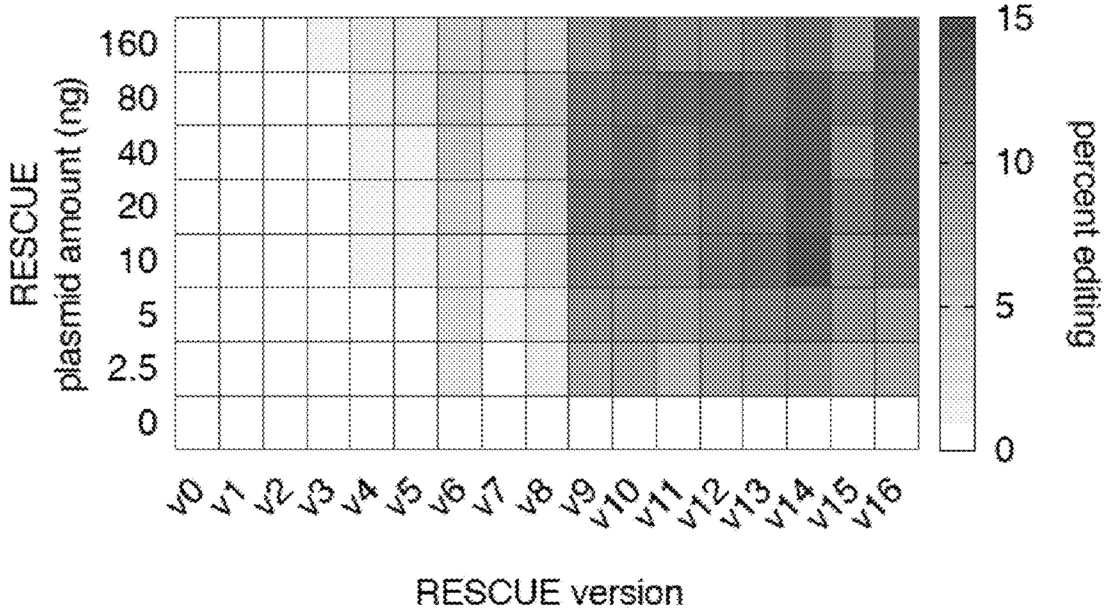
FIG. 88: Cytidine deamination activity of varying amounts of RESCUEv0-16 as measured by percent editing at a KRAS site. Values represent mean of three replicates.

As RESCUE was evolved to have activity on reporter constructs, Applicants evaluated how well RESCUE could work on endogenous transcripts in HEK293FT cells. Applicants tested a panel of guide RNAs with varying mismatch positions targeting 24 different sites across 9 genes (FIGS. 74A and 87A-87C), specifically choosing sites across these genes to have varying 5' base identities to interrogate the deamination activity on different motifs. Applicants found that RESCUEv16 achieved editing rates between ~5%-35% at all sites tested, and that the ideal mismatch position or base-flip was site dependent. Moreover, RESCUEv16 outperformed all other versions on multiple endogenous sites and required less dosing than earlier versions (FIGS. 74B and 88). To better evaluate the relevance of RESCUEv16 for therapeutics, Applicants designed a series of twenty-two 200 bp targets to model editing of disease-relevant mutations from ClinVar (see Table 20).

TABLE 20

Disease information for disease-relevant mutations

| Candidate | Gene | Diseases |
|---|---|---|
| NM_000071.2(CBS): c.325T > C (p.Cys109Arg) | CBS | Thoracic aortic aneurysm and aortic dissection |
| NM_000141.4(FGFR2): c.799T > C (p.Ser267Pro) | FGFR2 | Pfeiffer syndrome/Crouzon syndrome/Neoplasm of stomach |
| NM_000551.3(VHL): c.473T > C (p.Leu158Pro) | VHL | Von Hippel-Lindau syndrome |
| NM_002474.2(MYH11): c.3791T > C (p.Leu1264Pro) | MYH11 | Aortic aneurysm, familial thoracic 4/Thoracic aortic aneurysm and aortic dissection |
| NM_000018.3(ACADVL): c.848T > C (p.Val283Ala) | ACADVL | Very long chain acyl-CoA dehydrogenase deficiency |
| NM_002397.4(MEF2C): c.2T > C (p.Met1Thr) | MEF2C | Mental retardation, stereotypic movements, epilepsy, and/or cerebral malformations |
| NM_002834.4(PTPN11): c.853T > C (p.Phe285Leu) | PTPN11 | Noonan syndrome |
| NM_005609.3(PYGM): c.2392T > C (p.Trp798Arg) | PYGM | Glycogen storage disease, type V |
| NM_001256850.1(TTN): c.90211T > C (p.Cys30071Arg) | TTN | Limb-girdle muscular dystrophy, type 2J/Distal myopathy Markesbery-Griggs type/Hereditary myopathy with early respiratory failure/ Myopathy, early-onset, with fatal cardiomyopathy/Familial hypertrophic cardiomyopathy 9 |
| NM_005633.3(SOS1): c.806T > C (p.Met269Thr) | SOS1 | Noonan syndrome 4/Noonan syndrome |
| NM_015559.2(SETBP1): c.2612T > C (p.Ile871Thr) | SETBP1 | Schinzel-Giedion syndrome |
| NM_004572.3(PKP2): c.2386T > C (p.Cys796Arg) | PKP2 | Arrhythmogenic right ventricular cardiomyopathy, type 9 |
| NM_000138.4(FBN1): c.4222T > C (p.Cys1408Arg) | FBN1 | Marfan syndrome |
| NM_000375.2(UROS): c.217T > C (p.Cys73Arg) | UROS | Congenital erythropoietic porphyria |
| NM_014139.2(SCN11A): c.1187T > C (p.Leu396Pro) | SCN11A | not provided/Neuropathy, hereditary sensory and autonomic, type VII |
| NM_000152.4(GAA): c.1655T > C (p.Leu552Pro) | GAA | Glycogen storage disease, type II |
| NM_020630.4(RET): c.1858T > C (p.Cys620Arg) | RET | Multiple endocrine neoplasia, type 2a/Multiple endocrine neoplasia, type 2/MEN2A and FMTC |
| NM_000016.5(ACADM): c.199T > C (p.Tyr67His) | ACADM | Medium-chain acyl-coenzyme A dehydrogenase deficiency |
| NM_014874.3(MFN2): c.227T > C (p.Leu76Pro) | MFN2 | Charcot-Marie-Tooth disease, type 2A2A |
| NM_000341.3(SLC3A1): c.1400T > C (p.Met467Thr) | SLC3A1 | Cystinuria |

TABLE 20-continued

| Disease information for disease-relevant mutations | | |
|---|---|---|
| Candidate | Gene | Diseases |
| NM_000431.3(MVK): c.803T > C (p.Ile268Thr) | MVK | Mevalonic aciduria/Hyper-immunoglobulin D with periodic fever |
| NM_004004.5(GJB2): c.229T > C (p.Trp77Arg) | GJB2 | Deafness, autosomal recessive 1A/Deafness, autosomal dominant 3a/Nonsyndromic hearing loss and deafness |
| NM_000041.4(APOE): c.388T > C (p.Cys130Arg) | APOE | Alzheimer disease 2 |
| NM_000041.4(APOE): c.595T > C (p.Cys176Arg) | APOE | Alzheimer disease 2 |

Figure 74A:
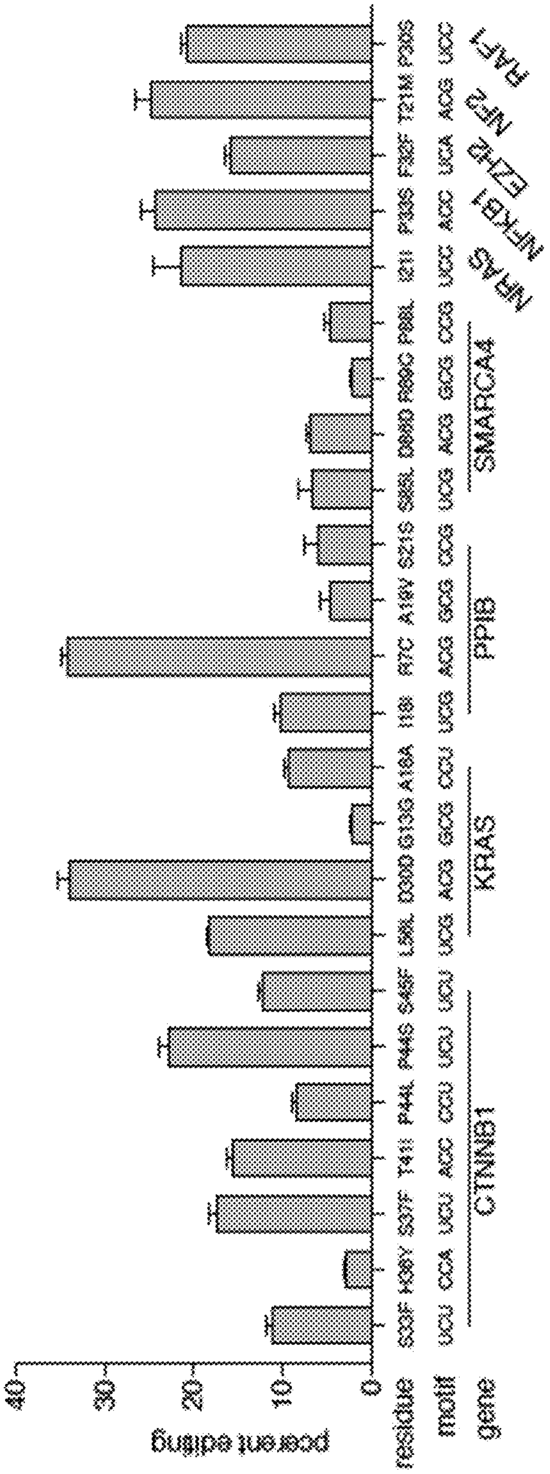
FIGS. 74A-74G: C to U editing by RESCUE on endogenous and disease relevant targets.
Figure 74C:
Figure 74B:
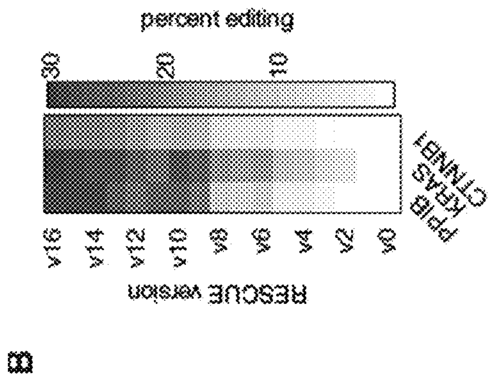
Figure 89:
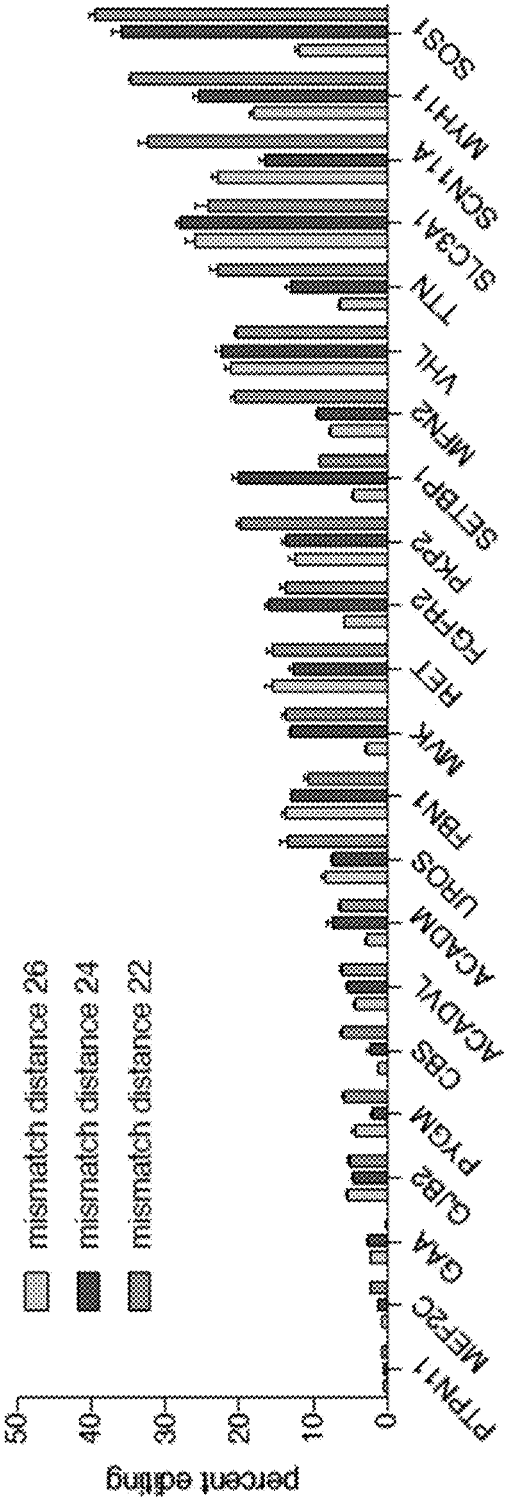
FIG. 89: Percent editing of various disease-relevant mutations on synthetic reporters using RESCUEv16 and guides with varying mismatch positions. Values represent mean+/−S.E.M (n=3).
Figure 90:
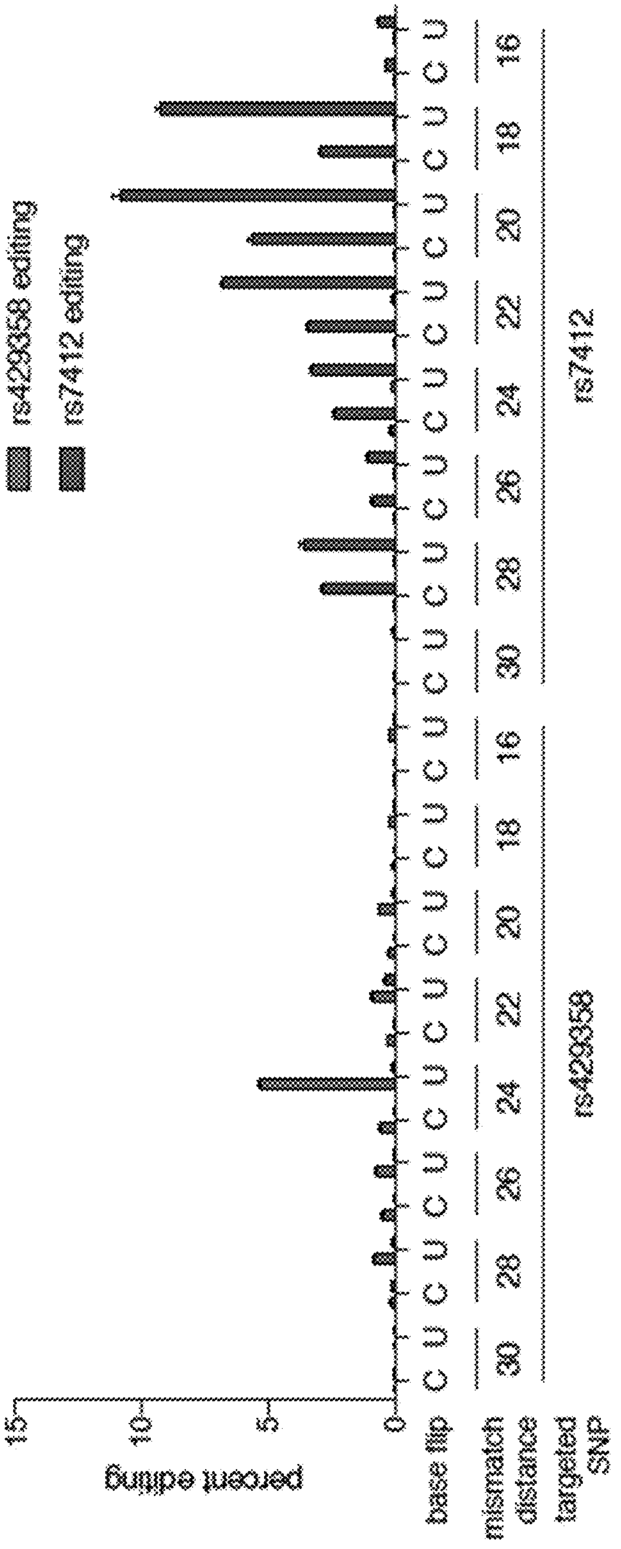
FIG. 90: Percent editing at the two ApoE4 cytosines (rs429358 and rs7412) using RESCUEv16 with guides of varying C and U mismatch positions. Values represent mean+/−S.E.M (n=3).

RESCUEv16 was able to edit these sites with efficiencies ranging from ~1%-42% (FIGS. 74C and 89). Applicants further tested therapeutic applications on the ApoE4 allele, which increased ~10 fold Alzheimer's ris 10 fold and involved two cytosine single-nucleotide polymorphisms that would need to be converted to thymines to generate the protective ApoE2 allele. Applicants tested RESCUEv16 on an expressed synthetic fragment from the ApoE4 allele and found that the system achieved editing of ~5% and 12% on the two sites (FIG. 90).

Figure 74D:
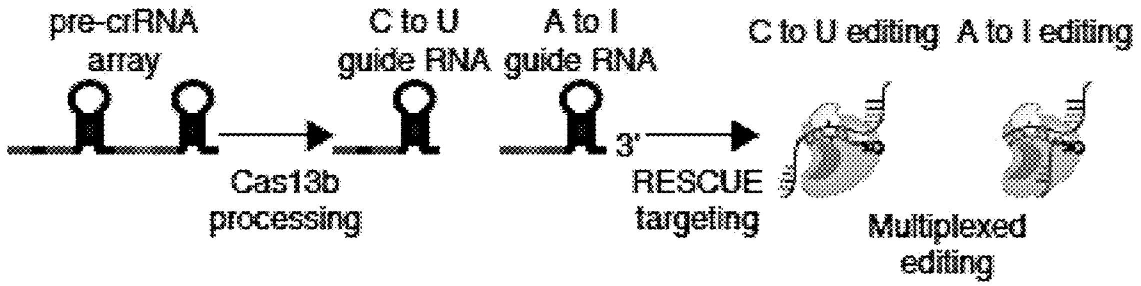
Figure 74E:
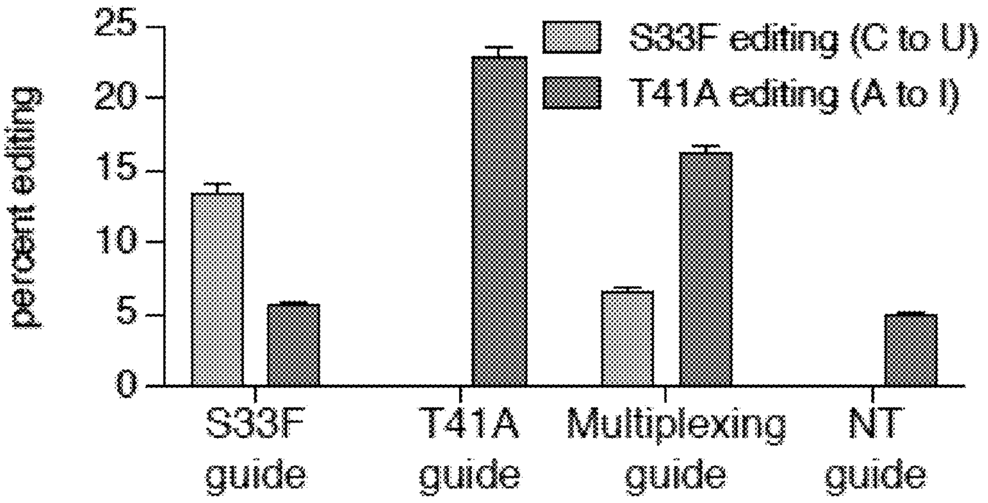
Figure 74F:
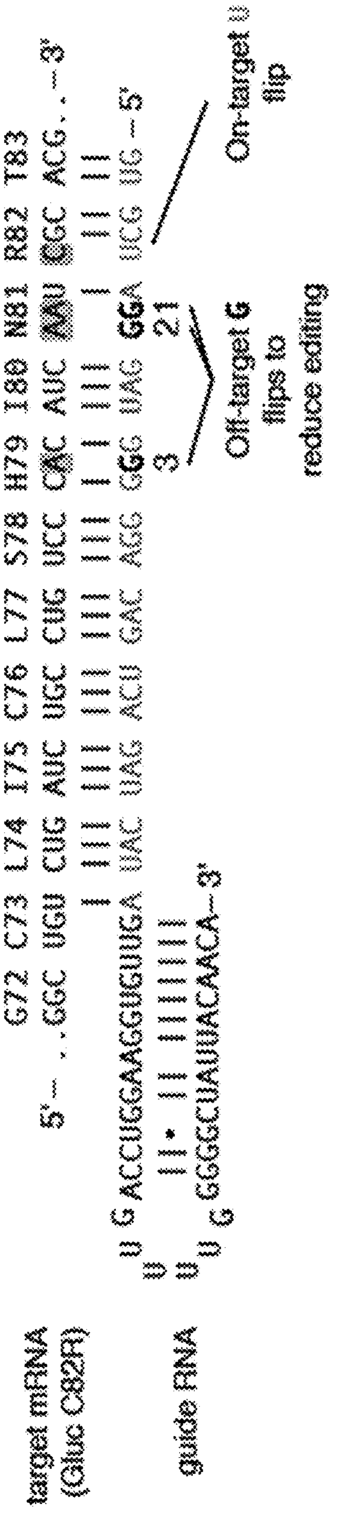
Figure 74G:
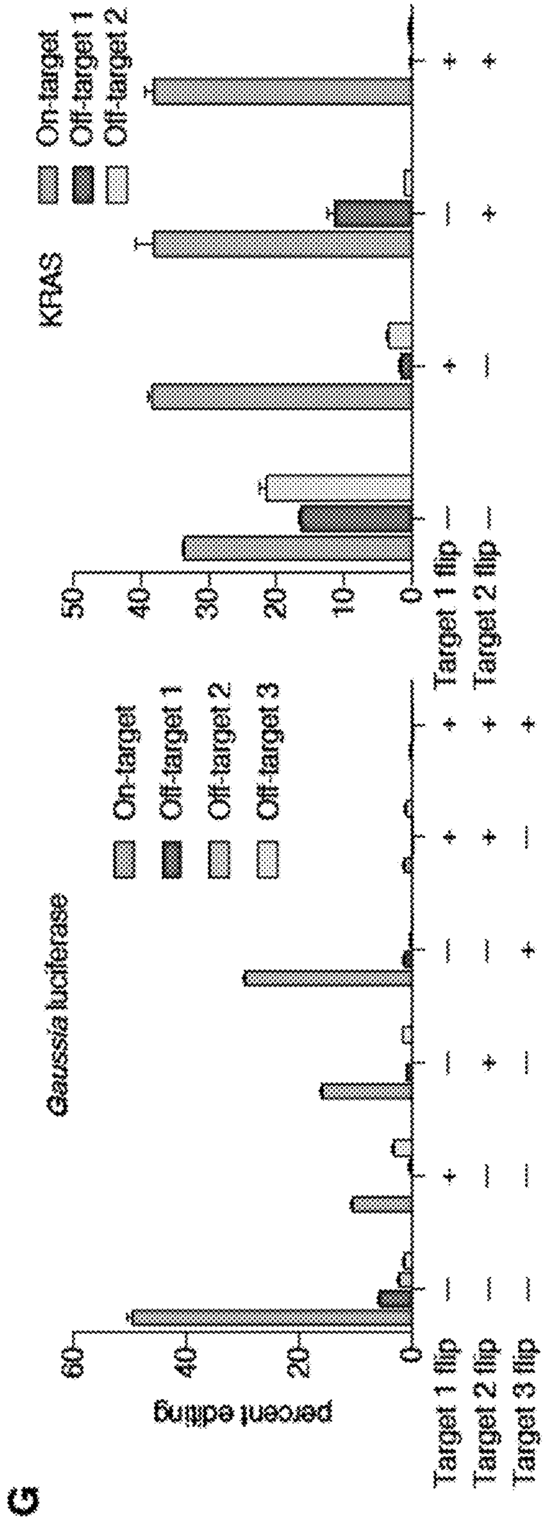
Figure 91A:
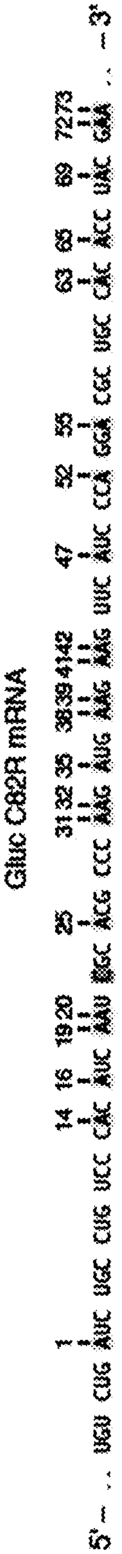
FIGS. 91A-91C: Specificity of RESCUE versions in the guide duplex window.
Figure 91B:
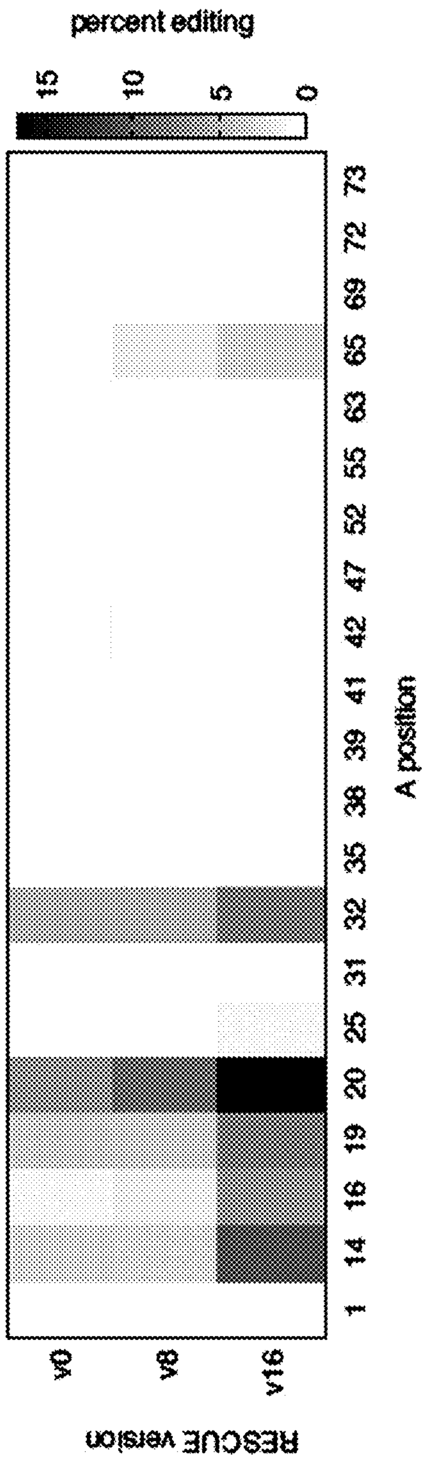
Figure 91C:
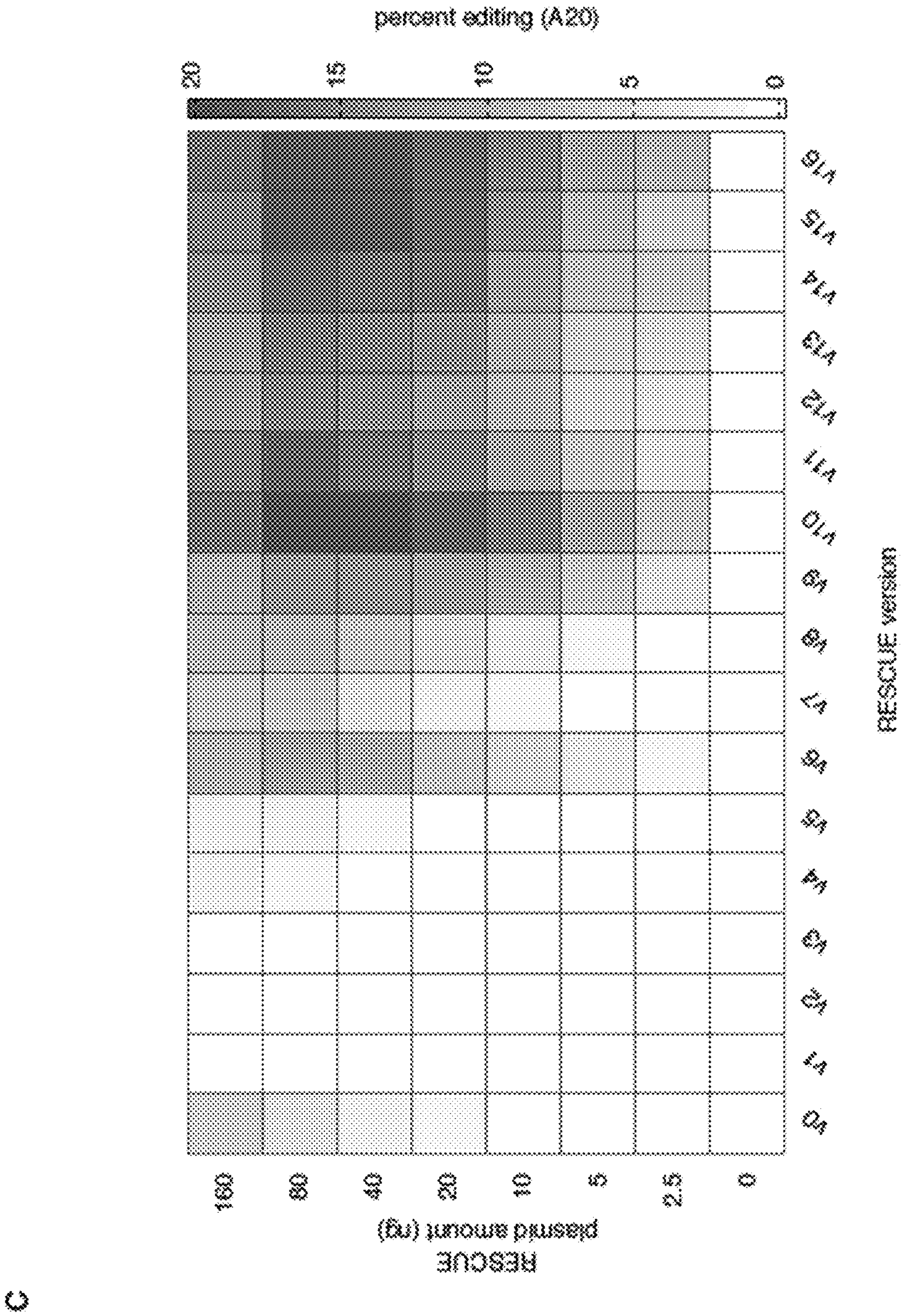
Figure 92A:
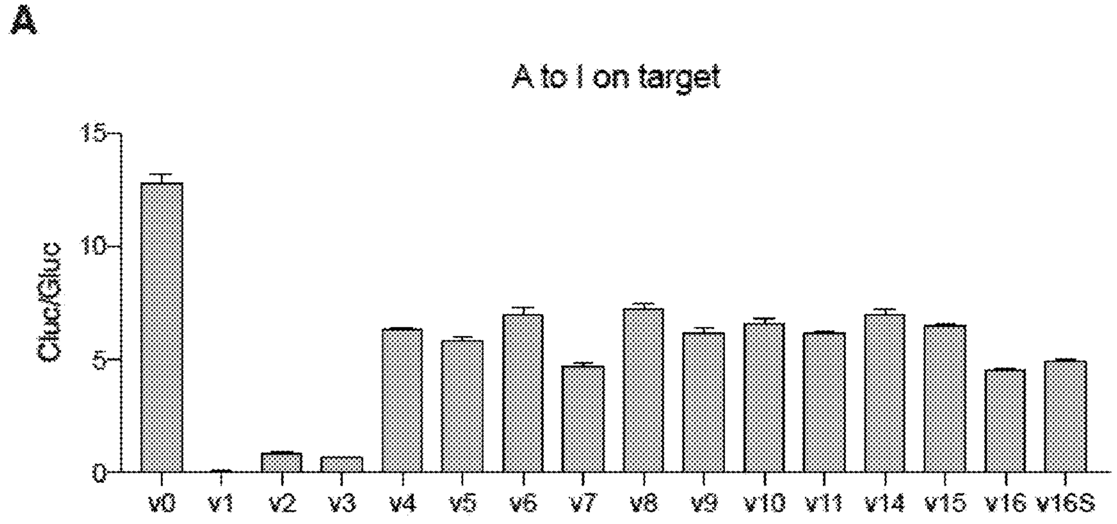
FIGS. 92A-92D: Adenosine deaminase activity of RESCUEv0-v16 and RESCUEv16S.
Figure 92B:
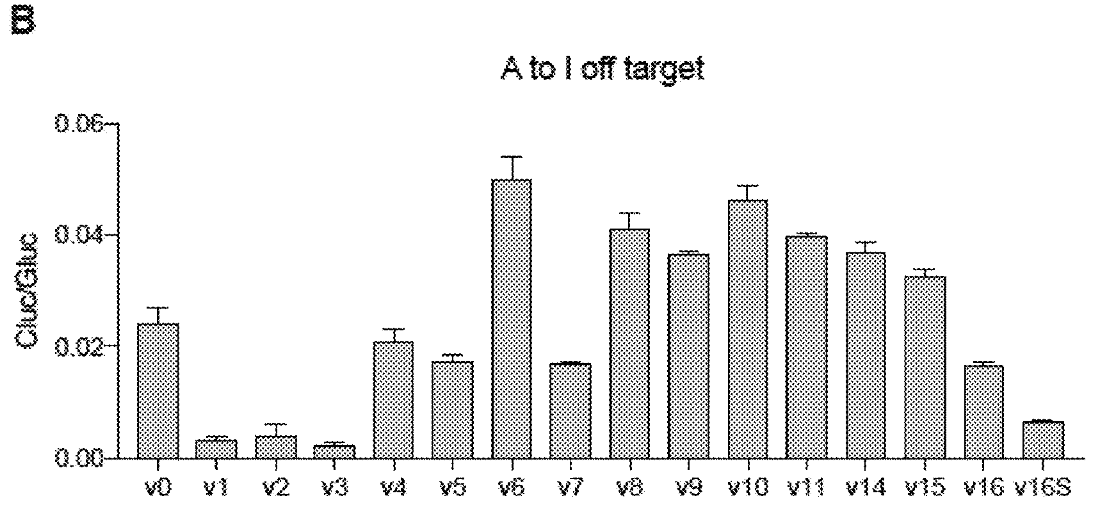
Figure 92C:
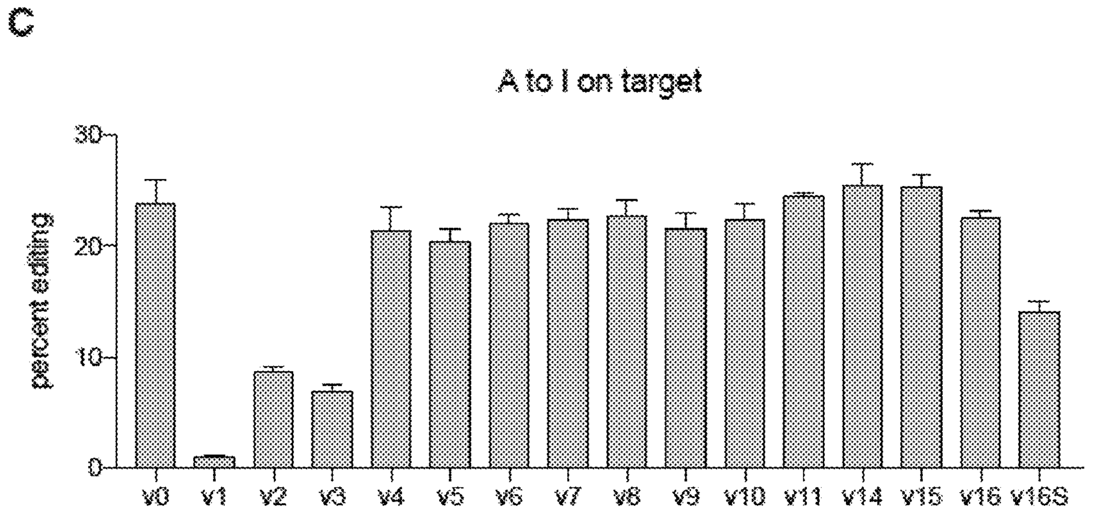
Figure 92D:
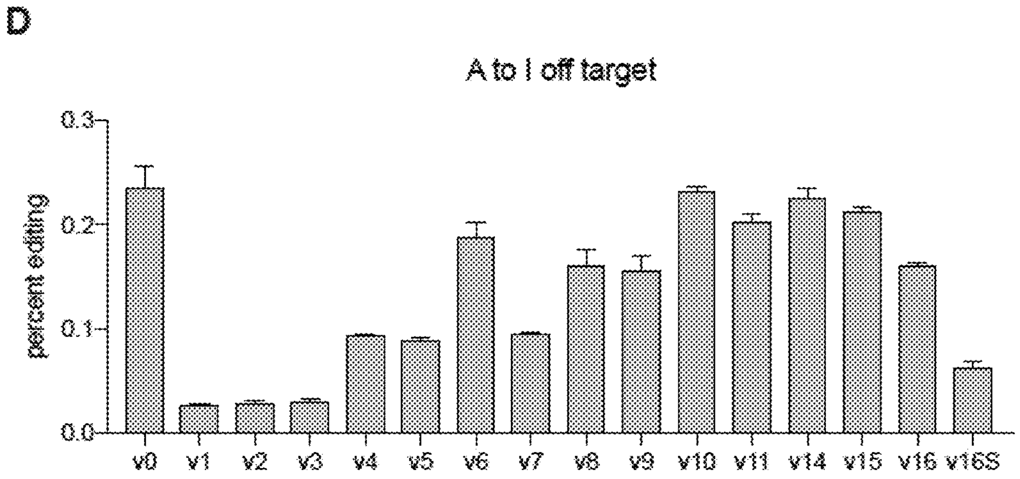
Figure 93A:
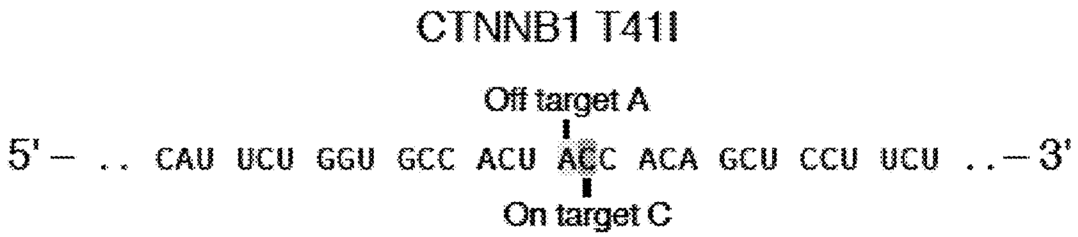
FIGS. 93A-93C: Cytidine deamination activity and off-target activity on a Beta-catenin target site using varying amounts of RESCUEv0-16 and RESCUEv16S.
Figure 93B:
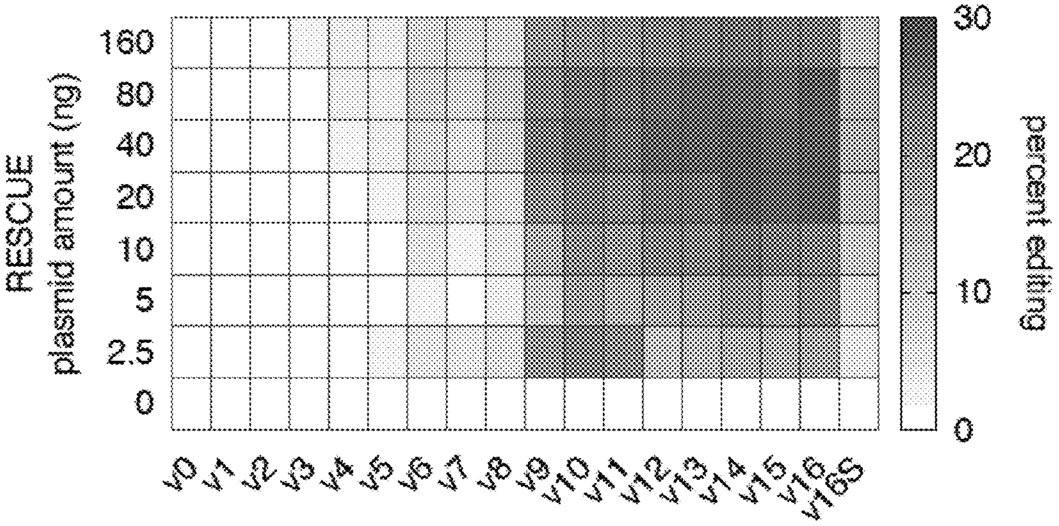
Figure 93C:
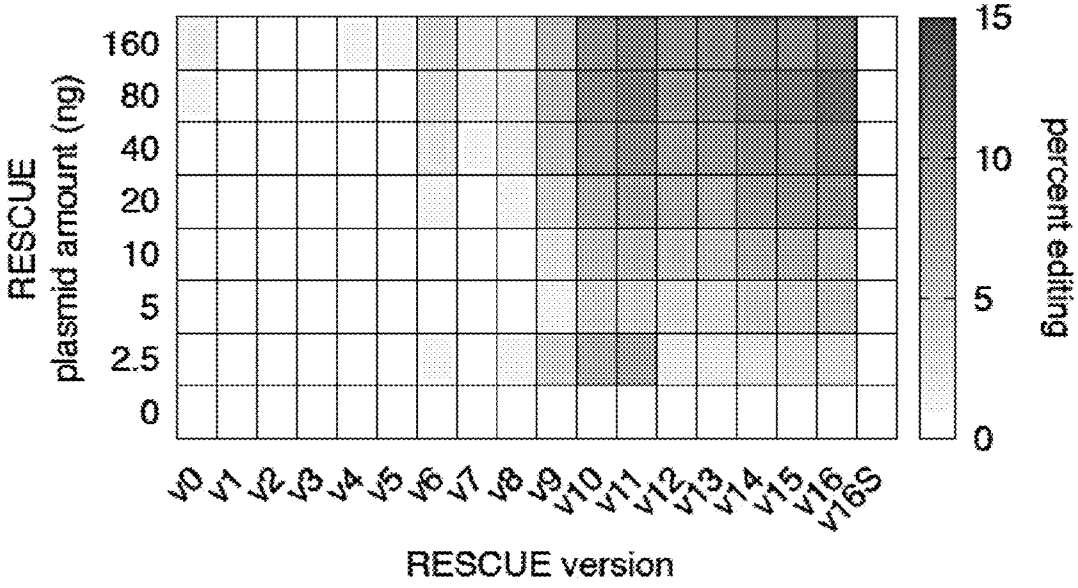
Figure 94A:
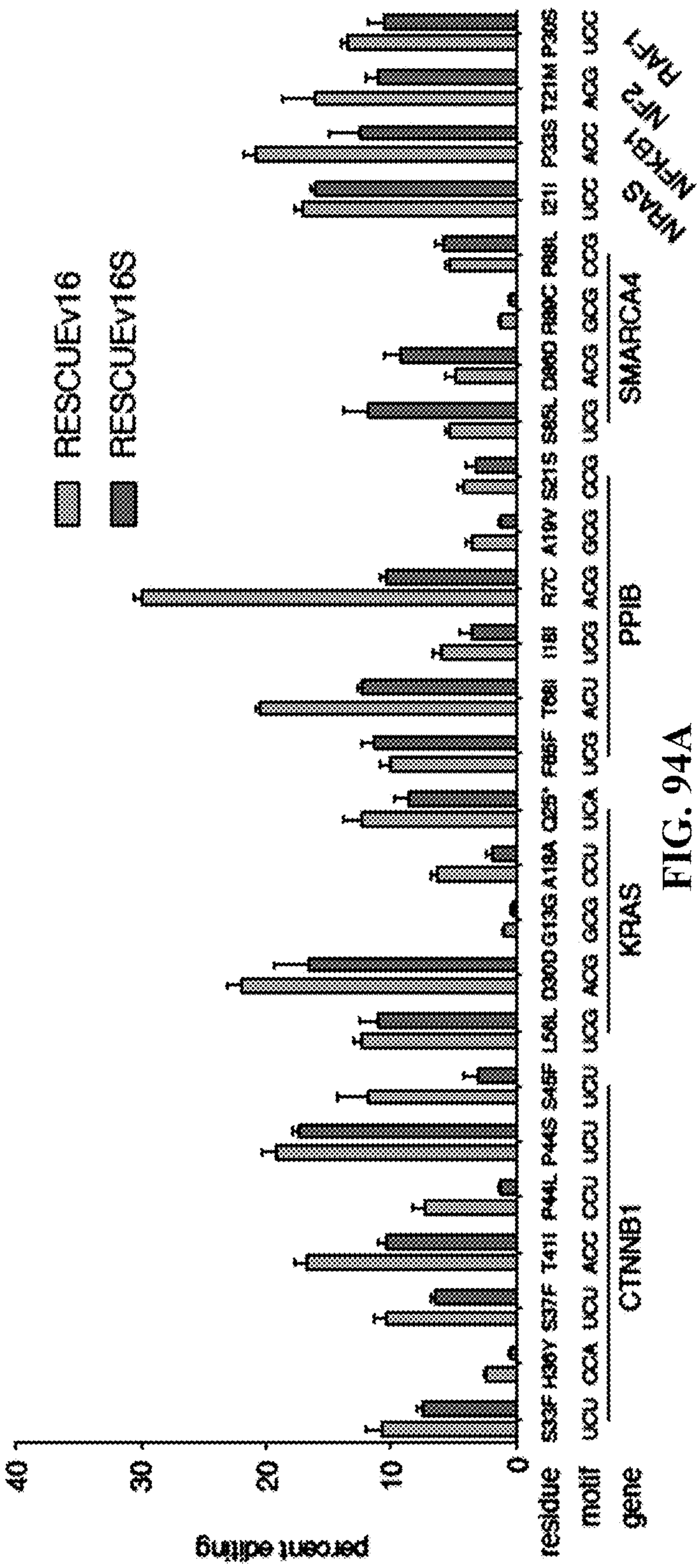
FIGS. 94A-94E: On target and off-target editing of RESCUEv16 and RESCUEv16S on endogenous targets.
Figure 94B:
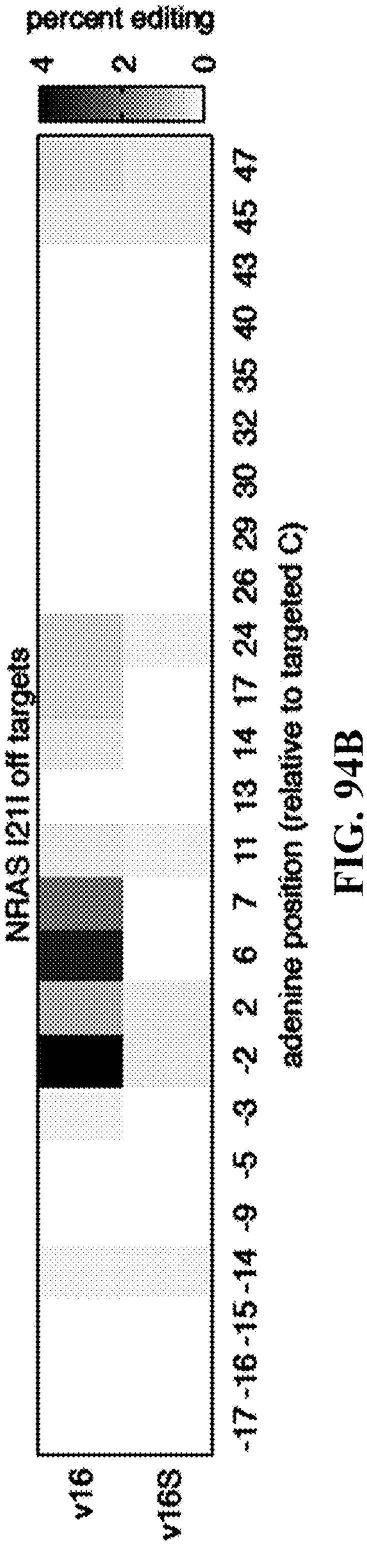
Figure 94C:
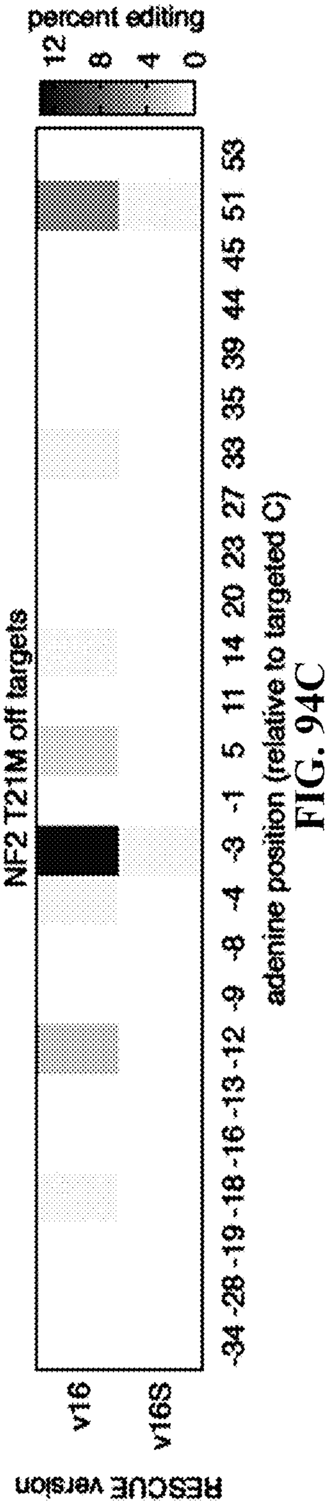
Figure 94D:
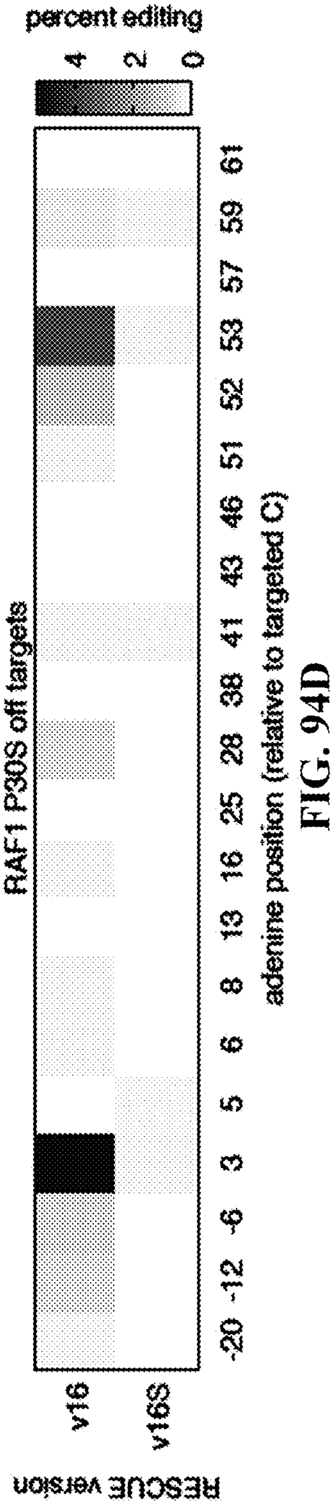
Figure 94E:
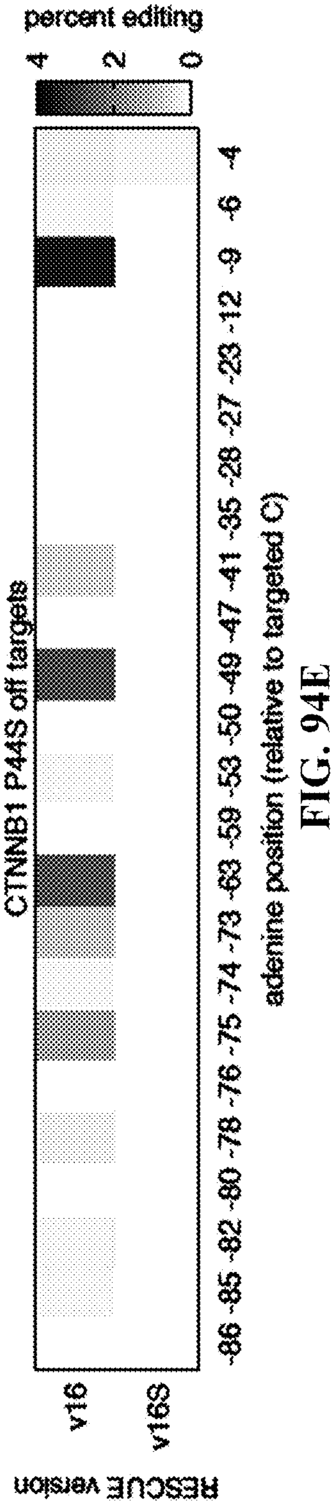

As RESCUEv16 retained adenosine deaminase activity, the native pre-crRNA processing activity of Cas13b enables multiplexed adenine and cytosine deamination. By delivering RESCUEv16 along with a pre-crRNA targeting an adenine and a cytosine in the same CTNNB1 transcript (FIG. 74D), Applicants found that RESCUEv16 was able to edit both targeted residues in the same population, converting the adenine to inosine and cytosine to uridine at rates of ~15% and 5%, respectively (FIG. 74E). Additionally, Applicants found when editing Gluc and endogenous genes, A to I off-targets near the targeted cytosine occurred within the guide duplex (FIGS. 91A-91C). To eliminate these off-targets, Applicants introduced disfavorable guanine mismatches in the guide across from off-target adenosines (FIG. 74F). This approach significantly reduced off-target editing on both Gluc and KRAS while minimally disrupting the on-target editing (FIG. 74G).

Figure 75A:
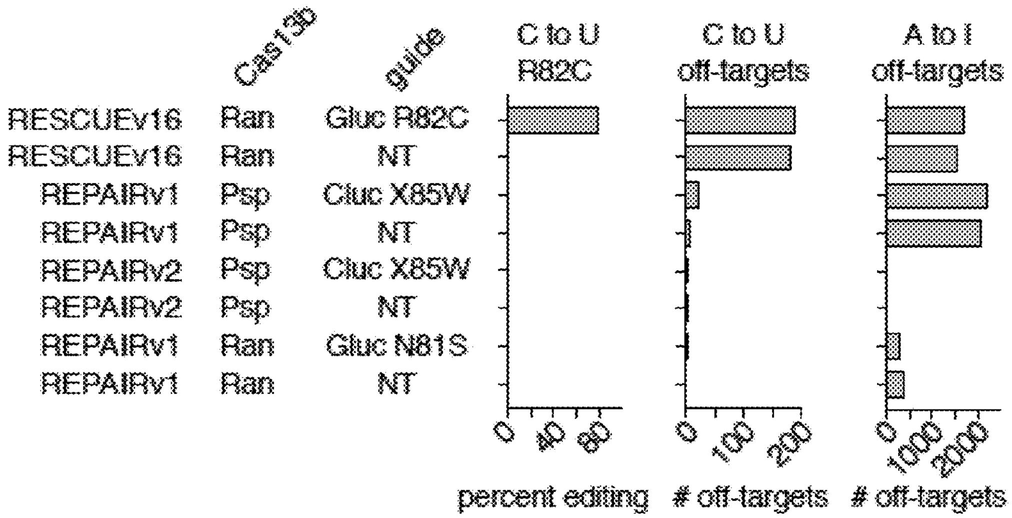
FIGS. 75A-75F: Transcriptome-wide specificity of RESCUEv16.
Figure 75B:
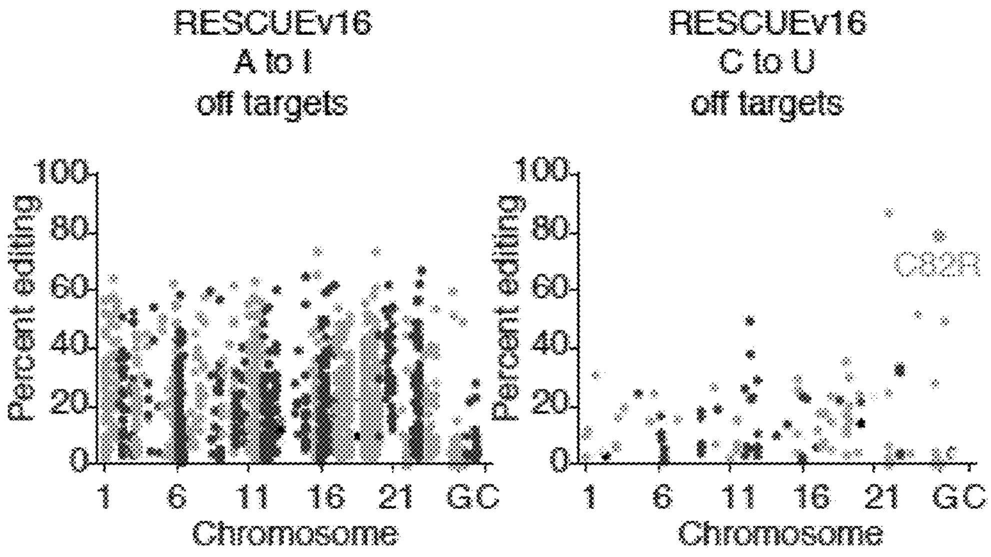
Figure 75C:
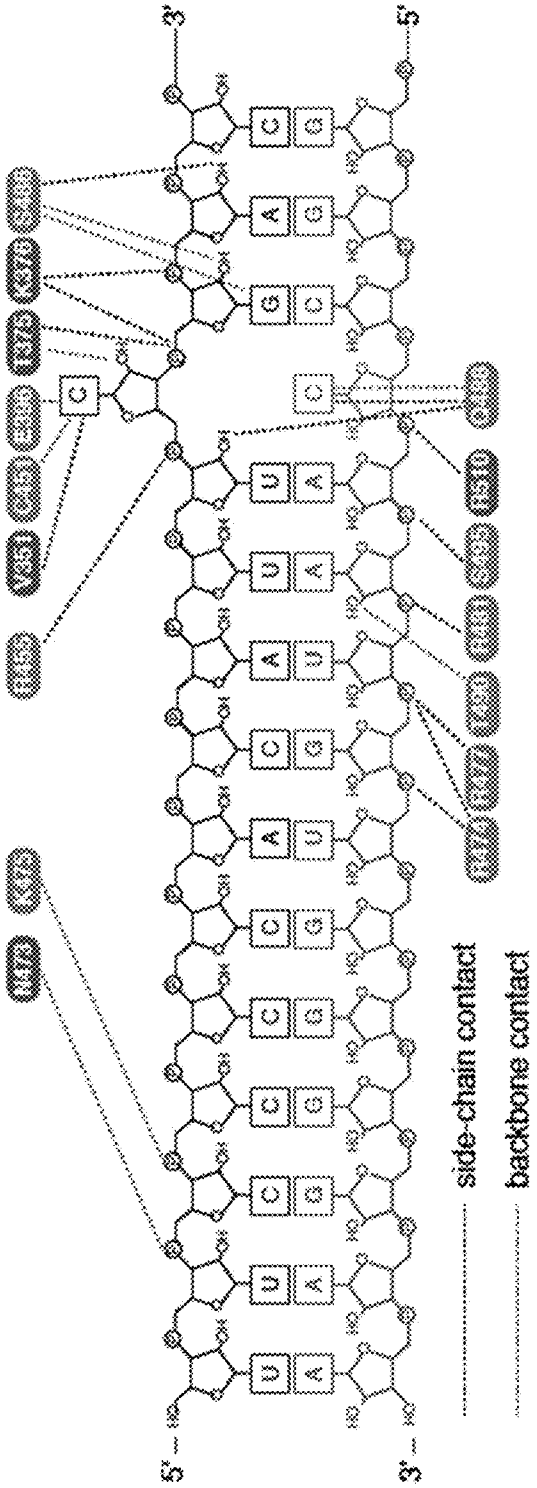
Figure 75D:
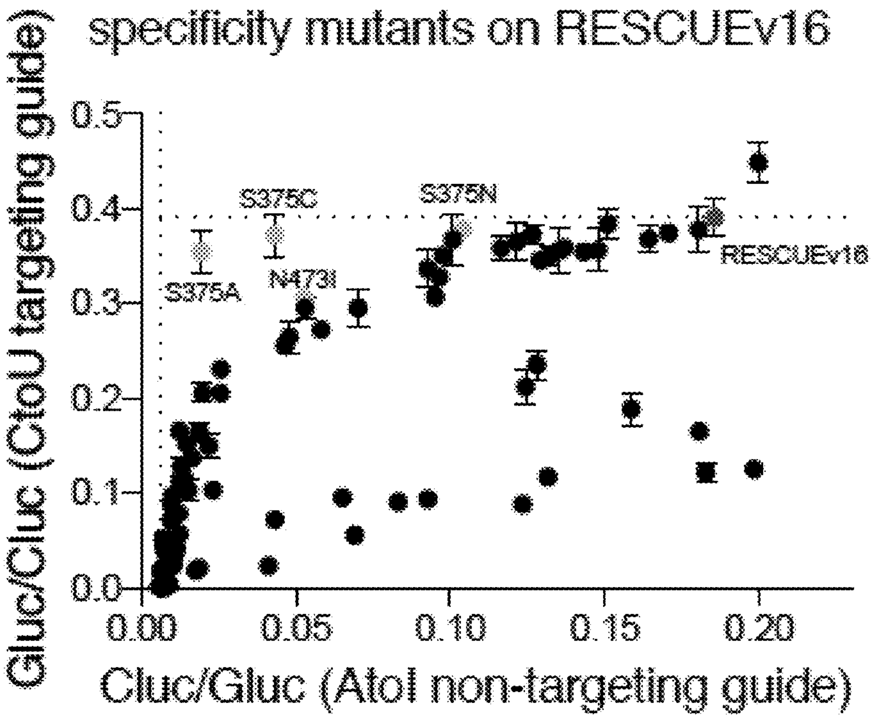
Figure 75E:
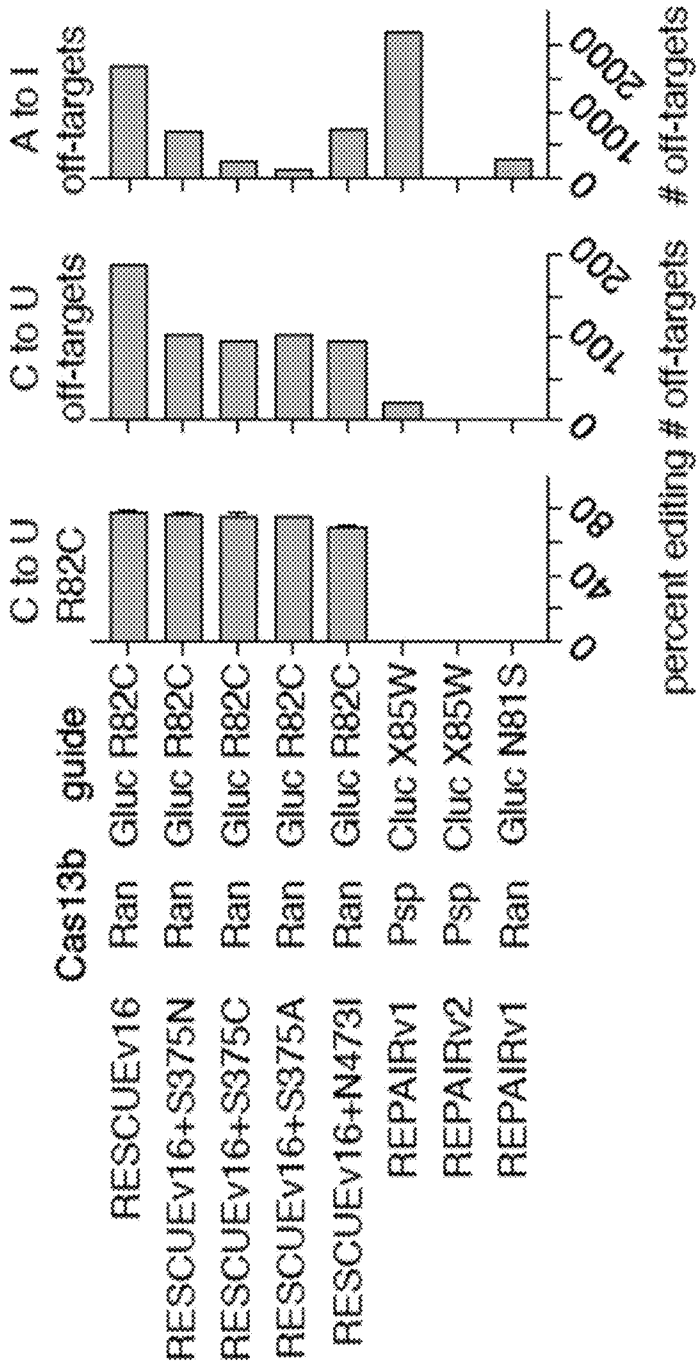
Figure 75F:
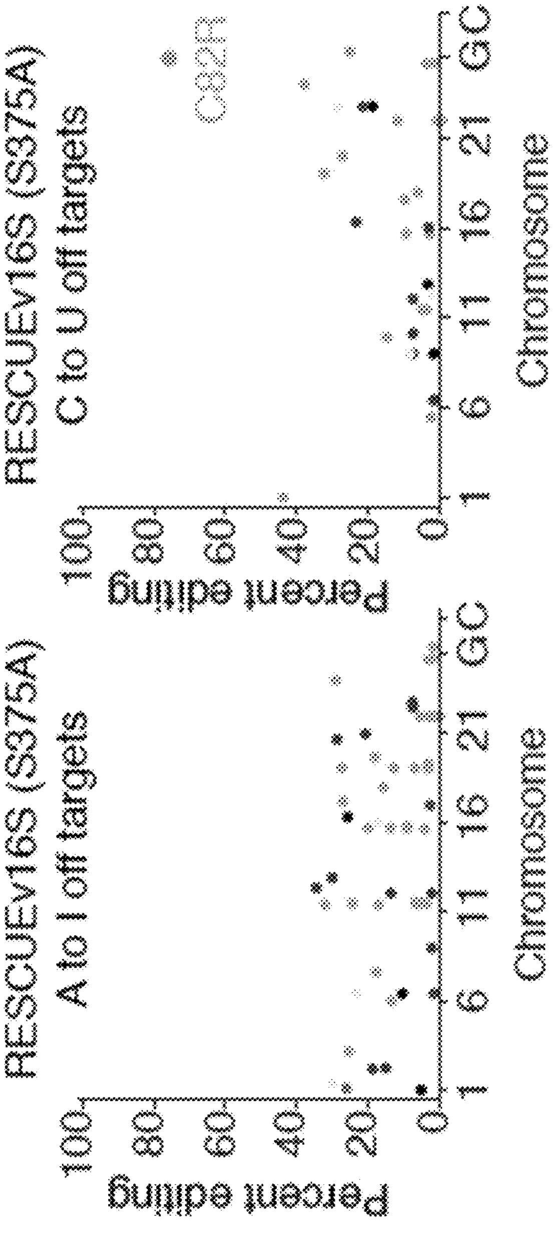

The A to I off-targets observed within the guide duplex window suggested that RESCUEv16 might have significant off-target adenosine deaminase activity across the transcriptome. Profiling off targets with whole-transcriptome RNA-sequencing, Applicants found that while RESCUEv16 had ~80% C to U editing on the Gluc transcript (FIG. 75A), it consequently had 188 C to U off-targets and 1,695 A to I off-targets, comparable to A to I off-targeting with REPAIRv1, which had 24 C to U off-targets and 2,214 A to I off-targets (FIGS. 75A, 75B). To improve the specificity of RESCUEv16, Applicants performed rational mutagenesis at residues interacting with the RNA target (FIG. 75C), resulting in multiple RESCUEv16 mutants with reduced A to I off-target activity, as measured by a luciferase reporter, and high C to U on-target deamination activity (FIG. 75D). The top specificity mutant, S375A on RESCUEv16 (RESCUEv16S), maintained ~76% on-target C to U editing (FIG. 75E), but only had 103 C to U off-targets and 139 A to I off-targets, an approximate 10-fold reduction in the number of adenine deamination off-targets (FIG. 75E, 75F). Although the off-target editing of RESCUEv16S was reduced, it still maintained significant on-target A to I editing activity (FIGS. 92A-92D). Applicants re-evaluated the efficacy of RESCUEv16S on the previous set of endogenous sites and found that it retained similar activity to RESCUEv16 at many sites and at a number of sites, performed better than RESCUEv16 (FIGS. 93A-93C and 94A). Moreover, within the guide duplex window, RESCUEv16S was much more specific, having significantly reduced editing at many local off-target sites (FIGS. 93C, 94B-94E).

Figure 76A:
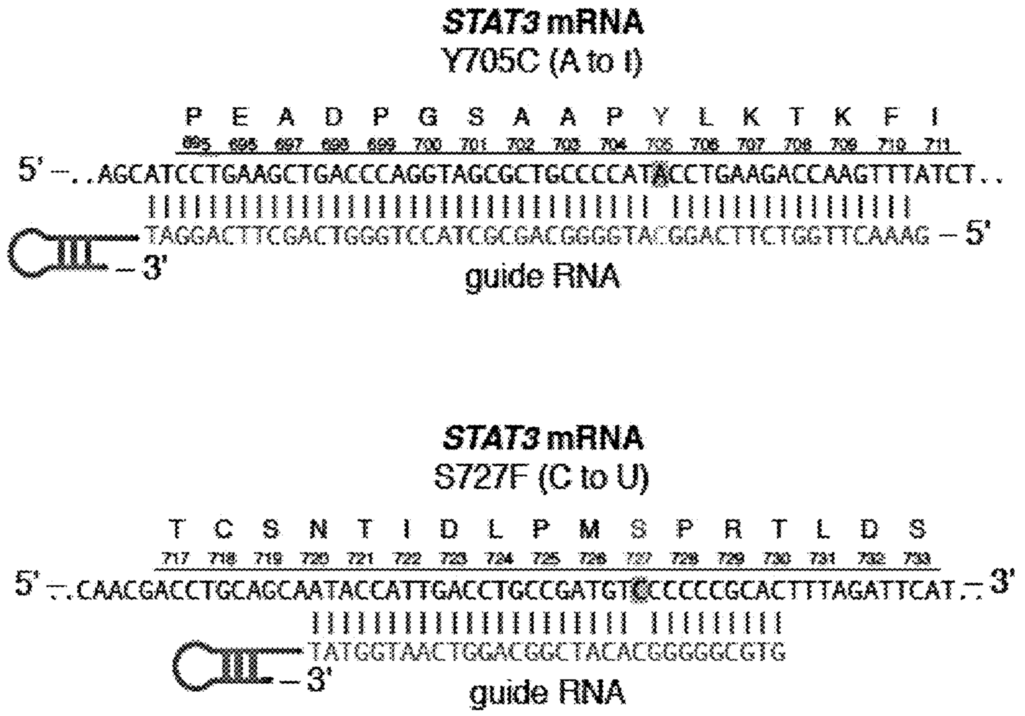
FIGS. 76A-76H: Phenotypic outcomes directed by C to U RNA editing for cell growth and signaling.
Figure 76B:
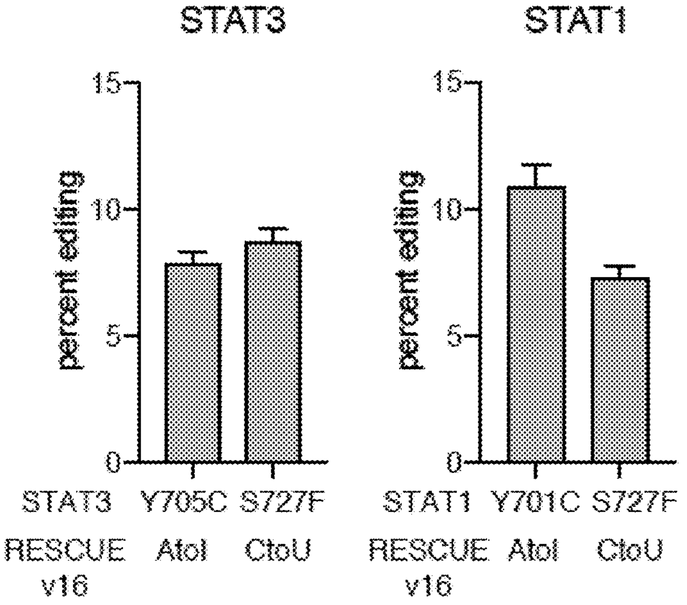
Figure 76C:
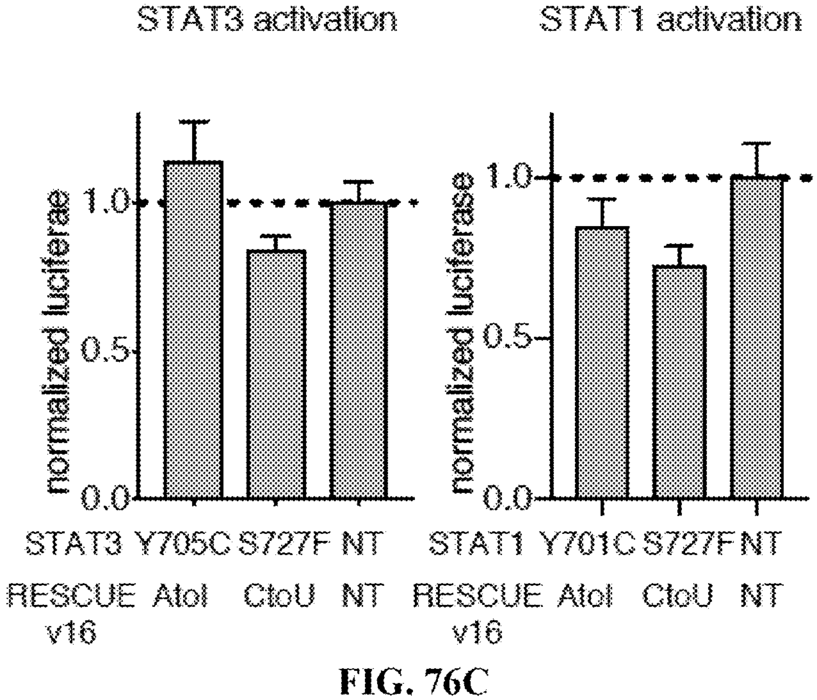
Figure 76D:
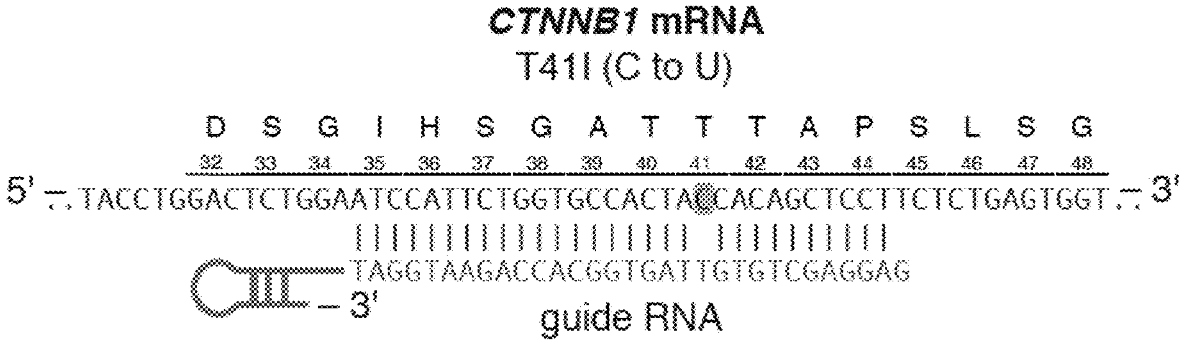
Figure 76E:
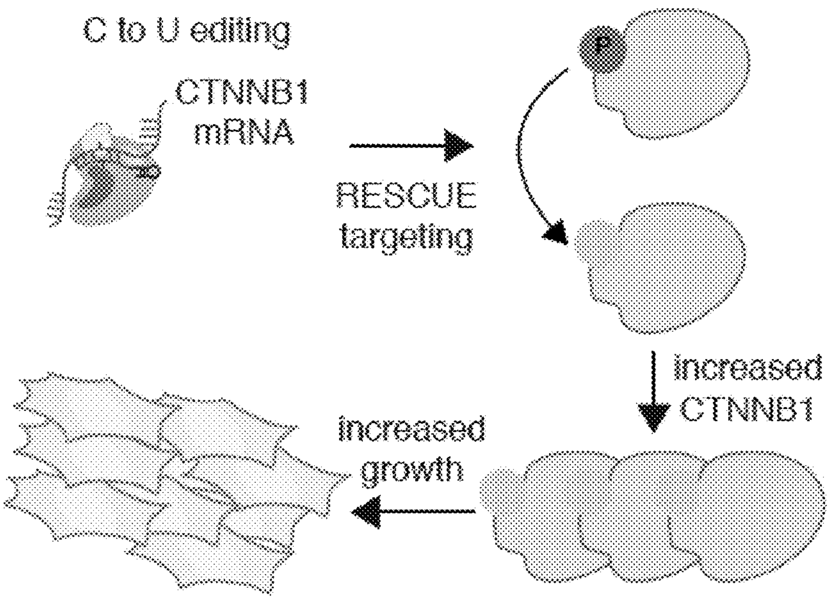

The cytidine and adenosine deamination activity of RESCUEv16 allowed for modulation of post-translational modifications via missense mutations, such as the phosphorylation substrates serine and tyrosine. STAT3 and STAT1 are transcription factors that play important roles in signal transduction via the JAK/STAT pathway and are typically activated by cytokines and growth factors. To demonstrate signaling modulation via RNA editing, Applicants altered activation of the STAT pathway by editing phosphorylation sites Y705 and S727 on STAT3 and Y701 and S727 on STAT1 with RESCUEv16 (FIG. 76A). In HEK293FT cells, Applicants observed 8% and 9% editing of the Y705 and S727 STAT3 sites, respectively, and 11% and 7% editing of the Y701 and S727 STAT1 sites, respectively (FIG. 76B). These edits resulted in 16%-27% repression of STAT3 and STAT1 activity using a luciferase reporter for STAT activation (FIG. 76C).

Figure 76F:
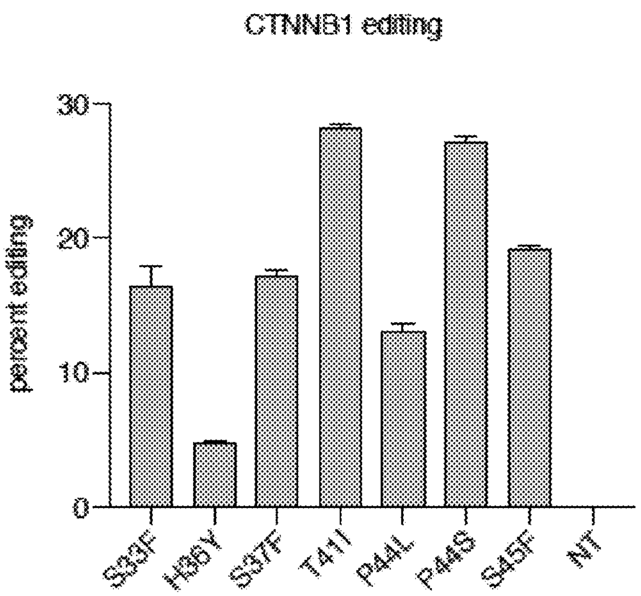
Figure 76G:
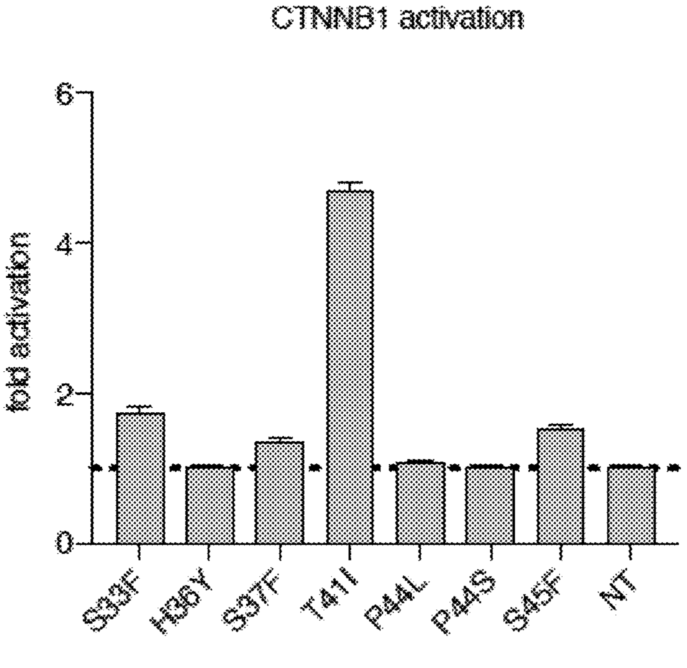
Figure 76H:
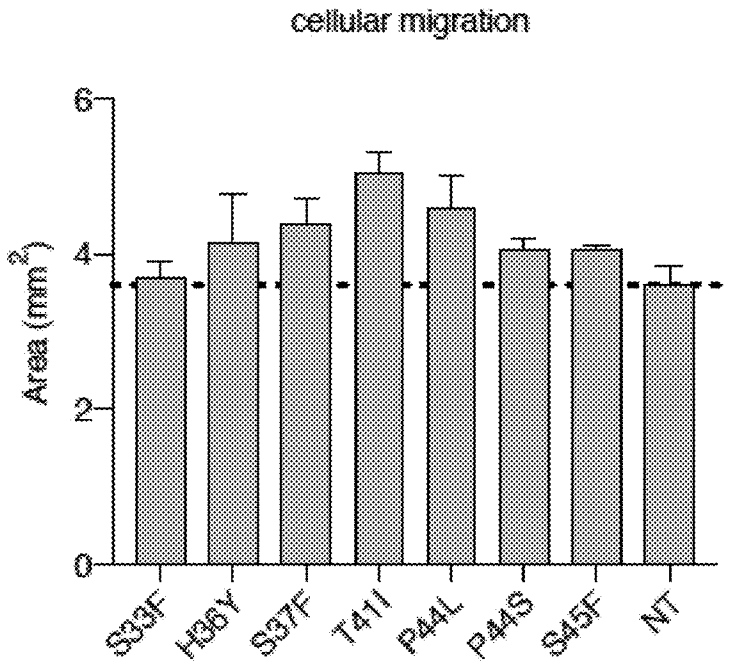

As with the JAK/STAT pathway, the Wnt pathway can be modulated by phosphorylation of constituent proteins, most notably Beta-catenin. Phosphorylated residues on Beta-Catenin, such as S33 and S37, promote ubiquitination and degradation. Wnt signaling blocks residue phosphorylation and stabilizes Beta-catenin, allowing the protein to engage transcription factors like LEF and TCF1/2/3, promoting expression of target genes, and leading to increased cell proliferation. Applicants tested a panel of guides against residues known to be involved in phosphorylation of Beta-catenin and found editing levels between 5%-28% (FIG. 76F), resulting in up to 5-fold activation of Beta-catenin (FIG. 76G) as measured by a TCF/LEF-dependent luciferase reporter. Correspondingly, cells transfected with RESCUEv16 targeting phosphorylation sites resulted in a 40% increase in cell growth in the most activated Beta-catenin condition, targeting the T41I conversion (FIG. 76H).

Figure 95B:
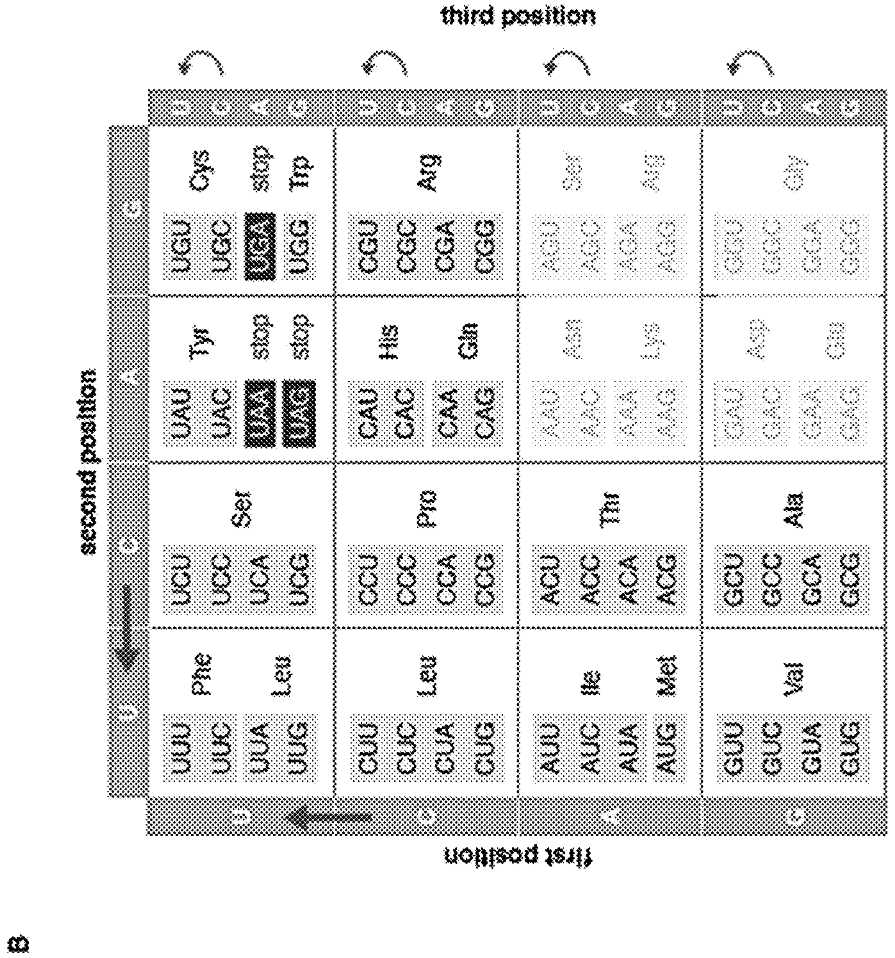
FIGS. 95A-95B: Summary of amino acid changes enabled by RESCUE.
Figure 95A:
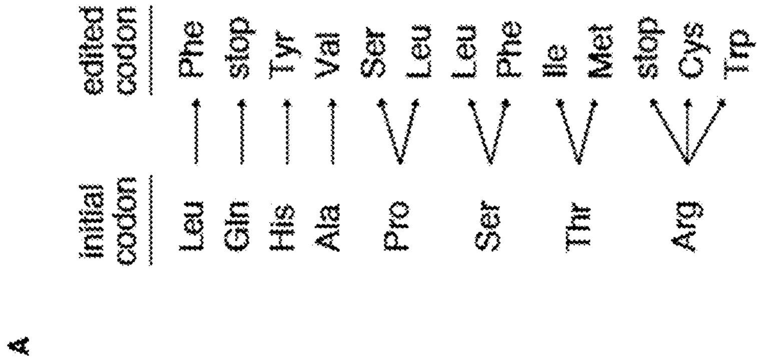

RESCUEv16 is a programmable base editing tool capable of precise cytidine to uridine conversion in RNA. Using directed evolution, Applicants demonstrated that adenosine deaminases can be relaxed to accept other bases, resulting in a novel cytidine deamination mechanism on that can edit double stranded RNA via base-flipping. Applicants have been able to boost the cytidine deaminase activity of ADAR2dd 1,000 fold, resulting in up to 40% editing on endogenous transcripts. Further rounds of evolution may be performed to boost the activity even more. The larger targetable amino acid space of RESCUE's cytidine deamination activity increased possible modulation of post-translational modifications, such as phosphorylation, glycosylation, and methylation sites, as well as better targeting common catalytic residues (FIGS. 95A-95B). Moreover, cytidine deamination activity allows for expanded targeting of disease-associated mutations with RNA editing and generation of protective alleles, such as ApoE2. Overall, RESCUE extended the RNA targeting toolkit with new base editing functionality, allowing for better modeling and treatment of genetic disease.

Figure 96:
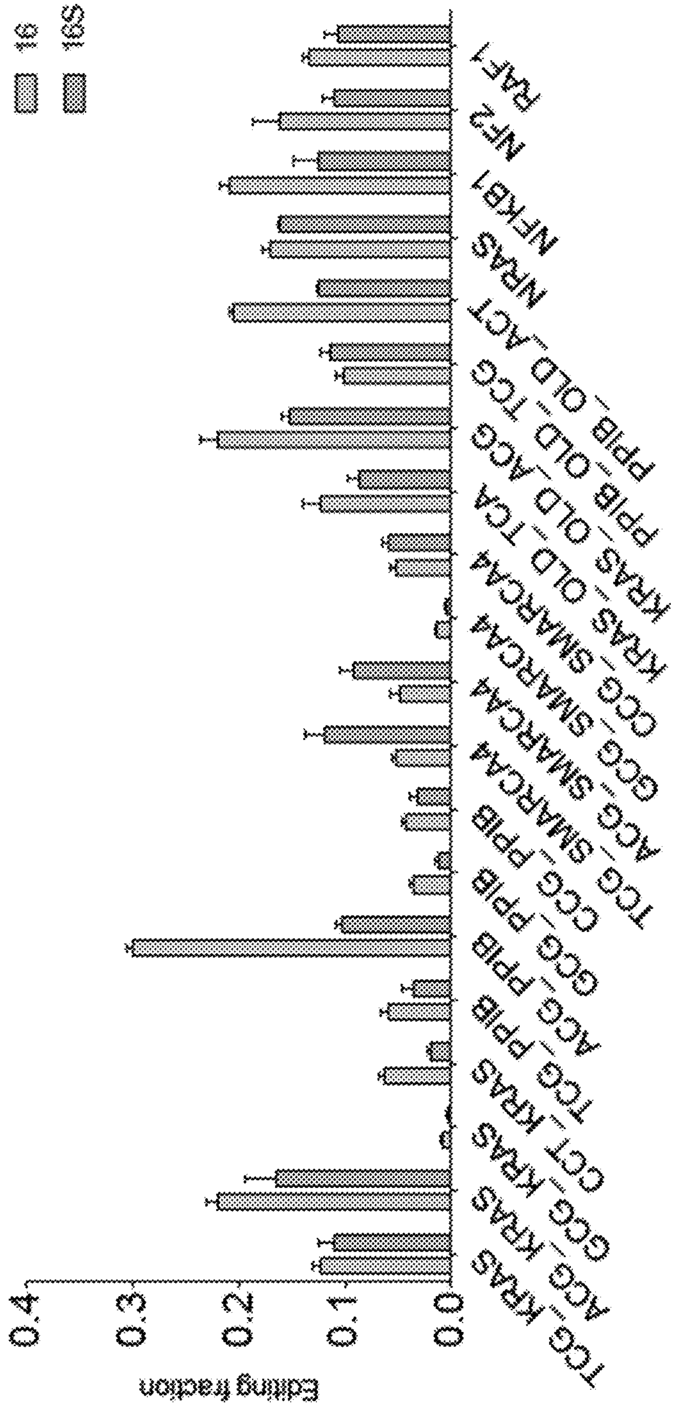
FIG. 96: RESCUE v16S was able to effectively edit endogenous genes.
Figure 97:
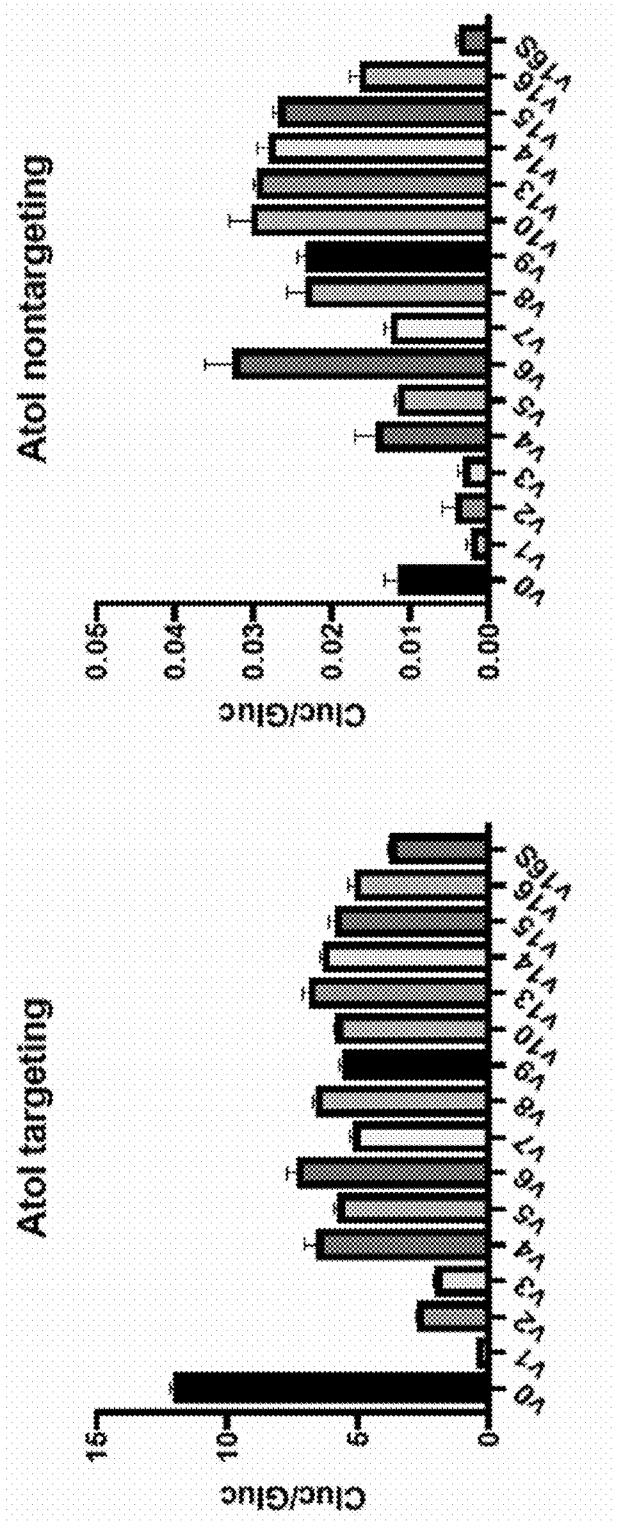
FIG. 97: RESCUE v16S maintained some A to I activity.
Figure 98:
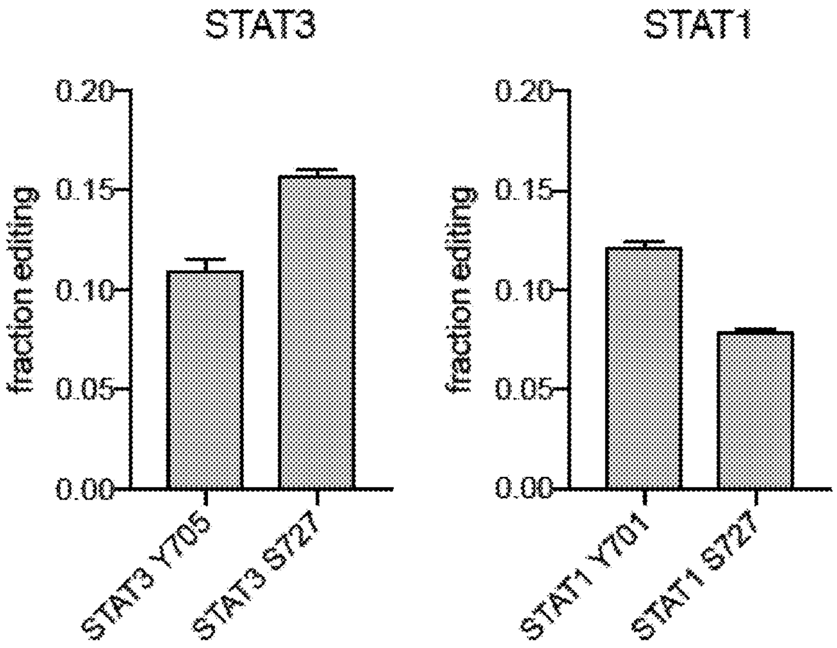
FIG. 98: RESCUE v16 was used to target STAT to reduce INFγ/IL6 induction.
Figure 99A:
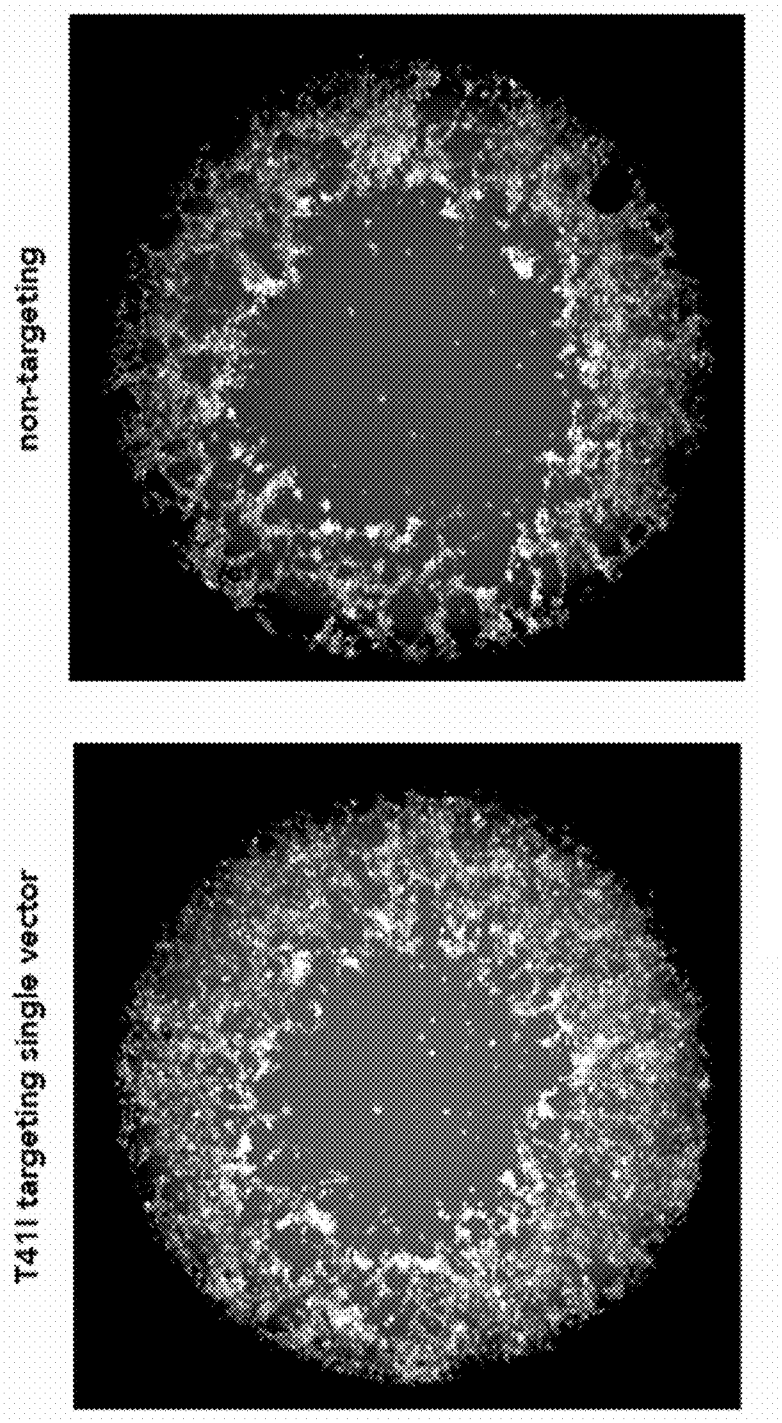
FIGS. 99A-99B: RESCUE targeting induces cell growth.
Figure 99B:
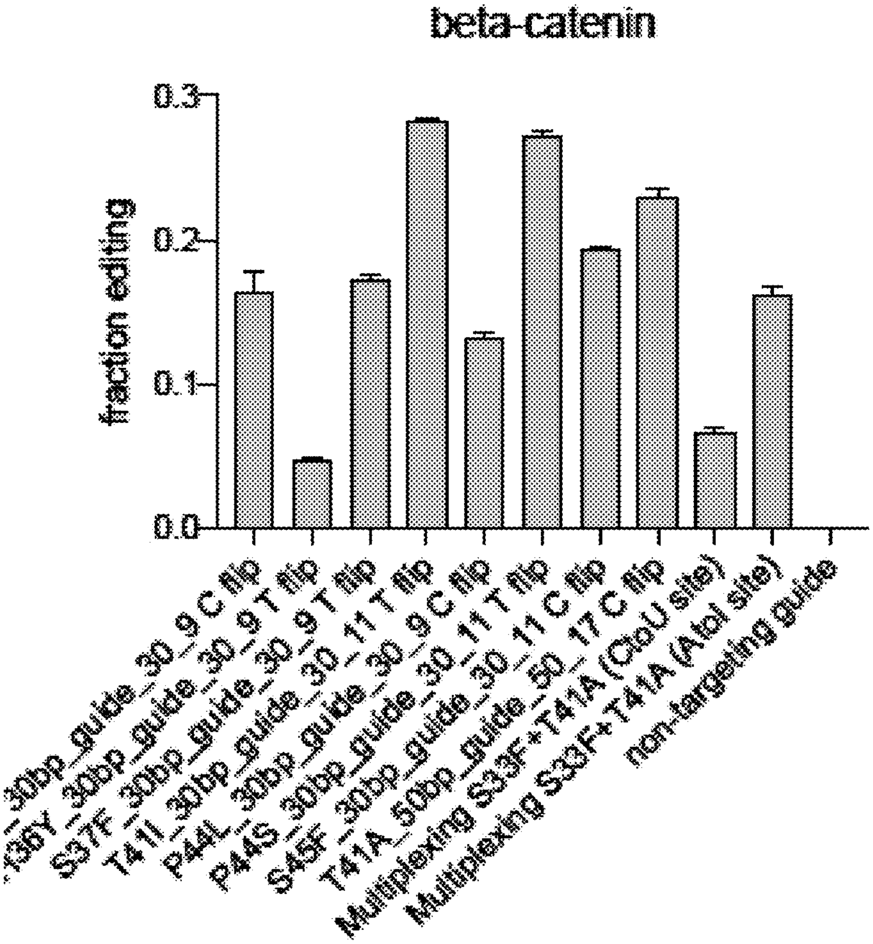
Figure 100:
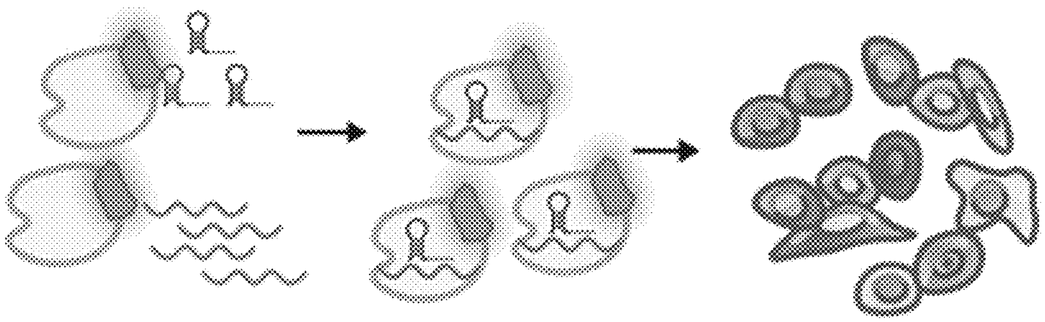
FIG. 100. A schematic showing an example transcript tracking method.

RESCUE v16S was able to effectively edit endogenous genes (FIG. 96). RESCUE v16S maintained some A to I activity (FIG. 97). RESCUE v16 was used to target STAT to reduce INFγ/IL6 induction (FIG. 98). RESCUE targeting induces cell growth (FIGS. 99A-99B).

Materials and Method

Design and Cloning of Yeast Constructs

For expression of the dRanCas13b-hADAR2dd construct in yeast, the fusion protein was cloned downstream of a pGAL promoter in a pRSII426 backbone, by modifying pML104 (Addgene #67638). To improve expression, a GS linker was cloned between the fusion proteins, and ADAR2dd was codon optimized for yeast. Additional codon mutations, corresponding to iterations of RESCUE, were introduced via Gibson Cloning.

Targeting plasmids for testing activity in yeast were engineered for both fluorescent screens (GFP) and auxotrophic selection screens (His). All targeting plasmids were cloned into the pYES3/CT backbone (Thermo Scientific). All plasmids contained a RanCas13b guide cassette for RESCUE, with expression driven by the ADH1 promoter, and spacer and DR sequences flanked by HH and HDV ribozymes [cite ng and dean]. A construct with the spacer replaced by a golden gate site was cloned to facilitate modular guide cloning.

To generate a GFP indicator of C to U RNA editing activity, the Y66H green-to-blue mutation was introduced into a yeast codon optimized EGFP (yeGFP) driven by the TEF promoter. Successful C to U RNA editing restores the green fluorescence of this construct. His reporters for C to U editing were generated by testing conserved residues in HIS3 for loss of activity when mutated to residues that could be rescued by RNA editing. Mutations that created inactive HIS3 were cloned into a HIS3 gene, under its native HIS3 promoter, in the pYES3/CT backbone.

Generation of Mutagenesis Libraries for Yeast Screening

To generate mutagenesis libraries for screening mutations in yeast systems, the hADAR2 deaminase domain was mutated using Genemorph II (Agilent Technologies) for error-prone PCR across eight 50 mL reactions differing in template input from 74 ng-9.4 μg via a two-fold dilution series. Following amplification, reactions were pooled, diluted 1:4 in DI water and loaded into a 2% gel containing ethidium bromide. Extracted samples were purified using a MinElute PCR Purification Kit (Qiagen) before treatment with Dpn1 (Thermo Fisher Scientific) at 37° C. for 2 h to remove residual template plasmid and subsequent gel and MinElute purification.

Backbone was generated by digesting 7 μg of template plasmid with KflI, RruI, and Eco72I (Thermo Fisher Scientific) for 1 hr. The digest was gel purified with the MinElute PCR Purification kit and eluted in 30 μL of pre-warmed water.

The purified PCR insert and digested backbone were ligated using Gibson Assembly (New England Biosciences), specifically, 456 ng of PCR insert and 800 ng of backbone digest were run in an 80 μL Gibson reaction for 1 hr. The product was condensed using isopropanol precipitation and resuspended in 12 μL of TE-EF redissolving buffer (Macherey-Nagel) and heating to 50° C. for 5 minutes while shaking at 300 r.p.m. 50 μL of Endura Electrocompetent cells (Lucigen) were thawed on ice for 10 minutes and 2 μL of resuspended Gibson product was added. The mixture was electroporated using a GenePulser Xcell (Bio-Rad) following optimal Endura settings (1.0 mm cuvette, 10 μF, 600 Ohms, and 1800 Volts). Samples from each electroporation were recovered in 1 mL of Recovery Media (Lucigen) and incubated at 37° C. for 1 hr while shaking at 300 r.p.m. Two electroporations were performed per mutagenesis library. The recovered culture was plated on a large pre-warmed 100 μg/mL ampicillin plate. Serial dilutions were prepared to determine the c.f.u. of each library. Plates were incubated at 37° C. for 16 hr and harvested using the Nucleobond Xtra Maxi Kit (Macherey-Nagel).

Transformation of Mutagenesis Libraries in Yeast

Large scale yeast transformation was carried out as previously described. Briefly, colonies containing the Y66H EGFP or HIS3 reporter plasmids were picked into 300 mL-Trp 2% glucose selection media and grown up overnight at 30° C. After growth, the OD600 of the cells were determined and 2.5e9 cells were added to 500 mL of pre-warmed 2×YPAD and incubated for 4 hours at 30° C. The cell pellet was washed multiple times and then resuspended in 36 mL of transformation mix containing 24 mL of PEG 3350 (50% w/v), 3.6 mL of 1.0 M Lithium acetate, 5 mL of denatured single-stranded carrier salmon sperm DNA at 2.0 mg/mL (ThermoFisher Scientific), 2.9 mL of water, and 500 μL of 1 μg/μL plasmid library. After incubation at 42° C. for 60 minutes, the cell pellet was resuspended in 750 mL of −Ura/−Trp 2% glucose selection media and grown overnight until the culture reached OD600 of 5-6. At that point, 6 mL of the culture was seeded into 250 mL of 2% raffinose −Ura/−Trp selection media and incubated until the OD600 was 0.5-1. Cultures were induced by adding 27 mL of 30% galactose and incubated overnight at 30° C. for 12-14 hours. Cells were then either subjected to cell sorting or plating on selection plates, as described below.

Fluorescent Cell Sorting of Yeast Libraries

After induction, cells were sorted on a SH800S Cell Sorter by gating for EGFP fluorescence compared to a negative non-induced and non-targeting guide control. After 100 million cells had been sorted into 2% glucose −Ura/−Trp selection media, Applicants incubated the sorted cells overnight, and then seeded them into 2% raffinose −Ura/−Trp selection media when their OD600 was 5-6. Cells were then induced when the OD600 was between 0.5-1 and incubated overnight for 12-14 hours before sorting again. Sorting was performed until 10-20 million cells had been sorted. The iterative growth and sorting was repeated 2-3 additional times and each iteration of sorted cells was plasmid harvested and sequenced by Ilumina NextSeq next generation sequencing to ascertain the mutants present at each round of selection. Top enriched mutants were individually ordered and cloned for mammalian validation testing as described below.

His Growth Selection of Yeast Libraries

After induction, the cell library was plated on 2% raffinose/3% galactose −Ura/−Trp/−His selection plates. As colonies grew, they were picked into water and streaked on 2% raffinose/3% galactose −Ura/−Trp/−His selection plates. After overnight growth of the streaks, colony PCR was performed on each streak and subjected to sanger sequencing of the ADAR2 catalytic domain as well as the His gene to check for recombination and DNA mutagenesis. Mutations were individually ordered and cloned for mammalian validation testing as described below.

Design and Cloning of Mammalian Constructs for RNA Editing

RanCas13b was made catalytically inactive (dRanCas13b) via histidine to alanine and arginine to alanine mutations (R142A/H147A/R1039A/H1044A) at the catalytic site of the HEPN domains. The deaminase domain and ADAR2 were synthesized and PCR amplified for Gibson cloning into pcDNA-CMV vector backbones and were fused to dRanCas13b at the C-terminus via a GS-mapkNES- GS (GSSLQKKLEELELGS (SEQ ID NO:309)) linker. Mutations in the ADAR2 deaminase domain for altering cytosine deamination activity or specificity were introduced by Gibson cloning into the dRanCas13b-GS-mapkNES-GS-ADAR2dd backbone. All mutations introduced into ADAR2dd for evolving C to U editing are listed in Table 25.

For comparison between different Cas13b orthologs, mutations tested on the dRanCas13b backbone were transferred to a dPspCas13b fusion vector by Gibson cloning onto the REPAIR construct, dPspCas13b-GS-HIVNES-GS-ADAR2dd. For testing the ADAR2dd alone without dRanCas13b and the full length ADAR2, Applicants used Gibson cloning to add all mutations to pcDNA-CMV vector backbones with ADAR2dd or full length ADAR2, previously cloned to test REPAIR.

Luciferase reporter vectors for measuring C to U RNA editing activity were generated by screening potential mutations in Gluc in the previously reported luciferase reporter plasmid. This reporter vector expresses functional Cluc as a normalization control, but a defective Gluc due to the addition of mutants (either C82R or L77P). To test RESCUE editing motif preferences, Applicants cloned every possible motif around the cytosine at codon 82 (AAX CXC) of Gluc. Secreted luciferase reporter vectors for testing CTNNB1 editing efficiency were generated from M50 Super 8× TOPFlash (Addgene #12456) and M50 Super 8× FOPFlash (Addgene #12457). The original firefly luciferase, under control of either TCF/LEF responsive elements (TOPFlash) or mock binding sites (FOPFlash) was replaced with a secreted *Gaussia* luciferase via Gibson cloning. An additional Cypridina luciferase with expression drive by a CMV promoter was cloned in to serve as a transfection control. All mammalian plasmids are listed in Table 22.

Selection of RESCUE Versions in Mammalian Cells

Mutations that performed comparable or better to the existing version of RESCUE were selected for screening on the entire panel of 6 luciferase reporters. For the selection of RESCUE v4 through v10, candidate mutations were initially screened on TCG motifs; RESCUE v11 was isolated using GCG motifs as the initial screening. Selection of RESCUE v12 through v14 were validated in mammalian cells using an initial screening on editing of the T41I residue of endogenous CTNNB1, resulting in beta-catenin pathway activation that was profiled with luminescent reporters of pathway activity, and RESCUE v15 and v16 were selected via activity on the L77P CCT motif of Gluc. All rounds and yeast screens used to generate them are listed in Table 25.

Cloning Pathogenic U>C Mutations for Assaying RESCUE Activity

To generate disease-relevant mutations for testing REPAIR activity, 23 U>C mutations related to disease pathogenesis, as defined in ClinVar, were selected (grouped as a panel of 22 genes and ApoE independently). Selected targets were ordered from Integrated DNA Technologies as 200-bp regions surrounding the mutation site, and were cloned downstream of mScarlet under a Ef1alpha promoter.

Guide Cloning for RESCUE

For expression of mammalian guide RNAs for RESCUE, a previously described construct with a RanCas13b direct repeat sequence preceded by golden-gate acceptor sites under U6 expression was used. Individual guides were cloned into this expression backbone by golden-gate cloning. To determine optimal guides for select sites, both C and U flips were tested, as well as tiling guides around the most common optimal guide range (mismatch distance of ~24).

Guide sequences for RESCUE experiments, all yeast plasmids, and all targeting guides used in yeast experiments are listed in Tables 21-26.

TABLE 21

Guide sequences used for luciferase editing

| Name | Targeted gene | Motif | Base flip/spacer length/ position | Codon change | Spacer sequence | Notes |
|---|---|---|---|---|---|---|
| UCG targeting guide | Gluc | UCG | C/30/26 | C82R | gugcCauugaugugggacaggcagaucaga (SEQ ID NO: 310) | No 5' G |
| GCG targeting guide | Gluc | GCG | U/30/20 | C82R | Guugggcgugcucuugaugugggacaggcag (SEQ ID NO: 311) | |
| ACG targeting guide | Gluc | ACG | C/30/28 | C82R | Ggccuuugaugugggacaggcagaucagaca (SEQ ID NO: 312) | |
| CCG targeting guide | Gluc | CCG | C/30/26 | C82R | Gugccguugaugugggacaggcagaucaga (SEQ ID NO: 313) | No 5' G |
| CCU targeting | Gluc | CCU | C/30/26 | L77P | Gggaacggcagaucagacagccccuggugca (SEQ ID NO: 314) | |
| CCA targeting | Gluc | CCA | C/30/26 | L77P | Gggauuggcagaucagacagccccuggugca (SEQ ID NO: 315) | |
| Motif guide UCU, flip U | Gluc | UCU | U/30/26 | L82F | gugaUauugaugugggacaggcagaucaga (SEQ ID NO: 316) | |

TABLE 21-continued

| Guide sequences used for luciferase editing | | | | | | |
|---|---|---|---|---|---|---|
| Name | Targeted gene | Motif | Base flip/spacer length/ position | Codon change | Spacer sequence | Notes |
| Motif guide UCG, flip U | Gluc | UCG | U/30/26 | C82R | gugcUauugaugugggaca ggcagaucaga (SEQ ID NO: 317) | |
| Motif guide UCC, flip U | Gluc | UCC | U/30/26 | P82S | guggUauugaugugggaca ggcagaucaga (SEQ ID NO: 318) | |
| Motif guide UCA, flip U | Gluc | UCA | U/30/26 | H82Y | guguUauugaugugggaca ggcagaucaga (SEQ ID NO: 319) | |
| Motif guide ACU, flip U | Gluc | ACU | U/30/26 | L82F | gugaUuuugaugugggaca ggcagaucaga (SEQ ID NO: 320) | |
| Motif guide ACG, flip U | Gluc | ACG | U/30/26 | C82R | gugcUuuugaugugggaca ggcagaucaga (SEQ ID NO: 321) | |
| Motif guide ACC, flip U | Gluc | ACC | U/30/26 | P82S | guggUuuugaugugggaca ggcagaucaga (SEQ ID NO: 322) | |
| Motif guide ACA, flip U | Gluc | ACA | U/30/26 | H82Y | guguUuuugaugugggaca ggcagaucaga (SEQ ID NO: 323) | |
| Motif guide GCU, flip U | Gluc | GCU | U/30/26 | L82F | gugaUcuugaugugggaca ggcagaucaga (SEQ ID NO: 324) | |
| Motif guide GCG, flip U | Gluc | GCG | U/30/26 | C82R | gugcUcuugaugugggaca ggcagaucaga (SEQ ID NO: 325) | |
| Motif guide GCC, flip U | Gluc | GCC | U/30/26 | P82S | guggUcuugaugugggaca ggcagaucaga (SEQ ID NO: 326) | |
| Motif guide GCA, flip U | Gluc | GCA | U/30/26 | H82Y | guguUcuugaugugggaca ggcagaucaga (SEQ ID NO: 327) | |
| Motif guide CCU, flip U | Gluc | CCU | U/30/26 | L82F | gugaUguugaugugggaca ggcagaucaga (SEQ ID NO: 328) | |
| Motif guide CCG, flip U | Gluc | CCG | U/30/26 | C82R | gugcUguugaugugggaca ggcagaucaga (SEQ ID NO: 329) | |
| Motif guide CCC, flip U | Gluc | CCC | U/30/26 | P82S | guggUguugaugugggaca ggcagaucaga (SEQ ID NO: 330) | |
| Motif guide CCA, flip U | Gluc | CCA | U/30/26 | H82Y | guguUguugaugugggaca ggcagaucaga (SEQ ID NO: 331) | |
| Motif guide UCU, flip C | Gluc | UCU | C/30/26 | L82F | gugaCauugaugugggaca ggcagaucaga (SEQ ID NO: 332) | |
| Motif guide UCC, flip C | Gluc | UCC | C/30/26 | P82S | guggCauugaugugggaca ggcagaucaga (SEQ ID NO: 333) | |
| Motif guide UCA, flip C | Gluc | UCA | C/30/26 | H82Y | guguCauugaugugggaca ggcagaucaga (SEQ ID NO: 334) | |

TABLE 21-continued

| Name | Targeted gene | Motif | Base flip/spacer length/ position | Codon change | Spacer sequence | Notes |
|---|---|---|---|---|---|---|
| Guide sequences used for luciferase editing | | | | | | |
| Motif guide ACU, flip C | Gluc | ACU | C/30/26 | L82F | gugaCuuugaugugggaca ggcagaucaga (SEQ ID NO: 335) | |
| Motif guide ACG, flip C | Gluc | ACG | C/30/26 | C82R | gugcCuuugaugugggaca ggcagaucaga (SEQ ID NO: 336) | |
| Motif guide ACC, flip C | Gluc | ACC | C/30/26 | P82S | guggCuuugaugugggaca ggcagaucaga (SEQ ID NO: 337) | |
| Motif guide ACA, flip C | Gluc | ACA | C/30/26 | H82Y | guguCuuugaugugggaca ggcagaucaga (SEQ ID NO: 338) | |
| Motif guide GCU, flip C | Gluc | GCU | C/30/26 | L82F | gugaCcuugaugugggaca ggcagaucaga (SEQ ID NO: 339) | |
| Motif guide GCG, flip C | Gluc | GCG | C/30/26 | C82R | gugcCcuugaugugggaca ggcagaucaga (SEQ ID NO: 340) | |
| Motif guide GCC, flip C | Gluc | GCC | C/30/26 | P82S | guggCcuugaugugggaca ggcagaucaga (SEQ ID NO: 341) | |
| Motif guide GCA, flip C | Gluc | GCA | C/30/26 | H82Y | guguCcuugaugugggaca ggcagaucaga (SEQ ID NO: 342) | |
| Motif guide CCU, flip C | Gluc | CCU | C/30/26 | L82F | gugaCguugaugugggaca ggcagaucaga (SEQ ID NO: 343) | |
| Motif guide CCC, flip C | Gluc | CCC | C/30/26 | P82S | guggCguugaugugggaca ggcagaucaga (SEQ ID NO: 344) | |
| Motif guide CCA, flip C | Gluc | CCA | C/30/26 | H82Y | guguCguugaugugggaca ggcagaucaga (SEQ ID NO: 345) | |
| Non-targeting guide | N/A | N/A | N/A | N/A | Guaaugccuggcuugucga cgcauagucug (SEQ ID NO: 346) | |
| Gluc specificity guide with off-target A-G mismatch 1 | Gluc | UCG | C/30/26 | C82R | ggugcuaGugaugugggac aggcagaucaga (SEQ ID NO: 347) | Additional G added specificity |
| Gluc specificity guide with off-target A-G mismatch 2 | Gluc | UCG | C/30/26 | C82R | ggugcuauGgaugugggac aggcagaucaga (SEQ ID NO: 348) | Additional G added specificity |
| Gluc specificity guide with off-target A-G mismatch 3 | Gluc | UCG | C/30/26 | C82R | ggugcuauugaugGgggac aggcagaucaga (SEQ ID NO: 349) | Additional G added specificity |
| Gluc specificity guide with off-target A-G combo 1 + 2 | Gluc | UCG | C/30/26 | C82R | ggugcuaGGgaugugggac aggcagaucaga (SEQ D NO: 350) | Additional G added specificity |

TABLE 21-continued

Guide sequences used for luciferase editing

| Name | Targeted gene | Motif | Base flip/spacer length/ position | Codon change | Spacer sequence | Notes |
|---|---|---|---|---|---|---|
| Gluc specificity guide with off-target A-G combo all | Gluc | UCG | C/30/26 | C82R | ggugcuaGGgaugGgggac aggcagaucaga (SEQ ID NO: 351) | Additional G added specificity |
| A to I REPAIR guide | Cluc | TAG | C/50/34 | *85w | Gcgcccugugcggacuccu ugucgccuucguaggugug gcagcguccuggg (SEQ ID NO: 352) | |
| Tiling guide 30 flip 30 U | Gluc | UCG | U/30/30 | C82R | Guauugaugugggacaggc agaucagacagc (SEQ ID NO: 353) | |
| Tiling guide 30 flip 28 U | Gluc | UCG | U/30/28 | C82R | Ggcuauugaugugggacag gcagaucagaca (SEQ ID NO: 354) | |
| Tiling guide 30 flip 26 U | Gluc | UCG | U/30/26 | C82R | Ggugcuauugaugugggac aggcagaucaga (SEQ ID NO: 355) | |
| Tiling guide 30 flip 24 U | Gluc | UCG | U/30/24 | C82R | Ggcgugcuauugauguggg acaggcagauca (SEQ ID NO: 356) | |
| Tiling guide 30 flip 22 U | Gluc | UCG | U/30/22 | C82R | Ggggcgugcuauugaugug ggacaggcagau (SEQ ID NO: 357) | |
| Tiling guide 30 flip 20 U | Gluc | UCG | U/30/20 | C82R | Guugggcgugcuauugaug uggacaggcag (SEQ ID NO: 358) | |
| Tiling guide 30 flip 18 U | Gluc | UCG | U/30/18 | C82R | Gucuugggcgugcuauuga ugugggacaggc (SEQ ID NO: 359) | |
| Tiling guide 30 flip 16 U | Gluc | UCG | U/30/16 | C82R | Gcaucuugggcgugcuauu gaugugggacag (SEQ ID NO: 360) | |
| Tiling guide 30 flip 14 U | Gluc | UCG | U/30/14 | C82R | Guucaucuugggcgugcua uugaugugggac (SEQ ID NO: 361) | |
| Tiling guide 30 flip 12 U | Gluc | UCG | U/30/12 | C82R | Gucuucaucuugggcgugc uauugauguggg (SEQ ID NO: 362) | |
| Tiling guide 30 flip 10 U | Gluc | UCG | U/30/10 | C82R | Gcuucuucaucuugggcgu gcuauugaugug (SEQ ID NO: 363) | |
| Tiling guide 30 flip 8 U | Gluc | UCG | U/30/8 | C82R | Gaacuucuucaucuugggc gugcuauugaug (SEQ ID NO: 364) | |
| Tiling guide 30 flip 6 U | Gluc | UCG | U/30/6 | C82R | Gugaacuucuucaucuugg gcgugcuauuga (SEQ ID NO: 365) | |
| Tiling guide 30 flip 4 U | Gluc | UCG | U/30/4 | C82R | Ggaugaacuucuucaucuu gggcgugcuauu (SEQ ID NO: 366) | |
| Tiling guide 30 flip 2 U | Gluc | UCG | U/30/2 | C82R | Ggggaugaacuucuucauc ugggcgugcua (SEQ ID NO: 367) | |

TABLE 21-continued

Guide sequences used for luciferase editing

| Name | Targeted gene | Motif | Base flip/spacer length/ position | Codon change | Spacer sequence | Notes |
|---|---|---|---|---|---|---|
| Tiling guide 50 flip 50 U | Gluc | UCG | U/50/50 | C82R | Guauugaugugggacaggc agaucagacagccccuggu gcagccagcuuuc (SEQ ID NO: 368) | |
| Tiling guide 50 flip 48 U | Gluc | UCG | U/50/48 | C82R | Ggcuauugaugugggacag gcagaucagacagccccug gugcagccagcuu (SEQ ID NO: 369) | |
| Tiling guide 50 flip 46 U | Gluc | UCG | U/50/46 | C82R | Ggugcuauugaugugggac aggcagaucagacagcccc uggugcagccagc (SEQ ID NO: 370) | |
| Tiling guide 50 flip 44 U | Gluc | UCG | U/50/44 | C82R | Ggcgugcuauugaugugggg acaggcagaucagacagcc ccuggugcagcca (SEQ ID NO: 371) | |
| Tiling guide 50 flip 42 U | Gluc | UCG | U/50/42 | C82R | Ggggcgugcuauugaugug ggacaggcagaucagacag ccccuggugcagc (SEQ ID NO: 372) | |
| Tiling guide 50 flip 40 U | Gluc | UCG | U/50/40 | C82R | Guugggcgugcuauugaug ugggacaggcagaucagac agccccuggugca (SEQ ID NO: 373) | |
| Tiling guide 50 flip 38 U | Gluc | UCG | U/50/38 | C82R | Gucuugggcgugcuauuga ugugggacaggcagaucag acagccccuggug (SEQ ID NO: 374) | |

TABLE 22

Guide sequences used for endogenous gene editing

| Name | Targeted gene | Motif | Base flip/ position | Codon change | Spacer sequence |
|---|---|---|---|---|---|
| S33F_CTNNB1_30bp_guide_30_9 C flip | CTNNB1 | UCU | 22 | S33F | GGGAUUCCACAGUCCA GGUAAGACUGUUGCU (SEQ ID NO: 375) |
| H36Y_CTNNB1_30bp_guide_30_9 T flip | CTNNB1 | CCA | 22 | H36Y | GACCAGAAUUGAUUCC AGAGUCCAGGUAAGA (SEQ ID NO: 376) |
| S37F_CTNNB1_30bp_guide_30_9 T flip | CTNNB1 | UCU | 22 | S37F | GUGGCACCAUAAUGGA UUCCAGAGUCCAGGU (SEQ ID NO: 377) |
| T41I_CTNNB1_30bp_guide_30_11 T flip | CTNNB1 | ACC | 20 | T41I | GAGGAGCUGUGUUAGU GGCACCAGAAUGGAU (SEQ ID NO: 378) |
| P44L_CTNNB1_30bp_guide_30_9 C flip | CTNNB1 | CCU | 22 | P44L | GUCAGAGAACGAGCUG UGGUAGUGGCACCAG (SEQ ID NO: 379) |

TABLE 22-continued

Guide sequences used for endogenous gene editing

| Name | Targeted gene | Motif | Base flip/ position | Codon change | Spacer sequence |
|---|---|---|---|---|---|
| P44S_CTNNB1_30bp_guide_30_11 T flip | CTNNB1 | UCU | 20 | P44S | GCUCAGAGAAGUAGCU GUGGUAGUGGCACCA (SEQ ID NO: 380) |
| S45F_CTNNB1_30bp_guide_30_11 C flip | CTNNB1 | UCU | 20 | S45F | GACCACUCAGACAAGG AGCUGUGGUAGUGGC (SEQ ID NO: 381) |
| TCG_KRAS_30bp_guide_30_7 T flip | KRAS | UCG | 24 | L56L | GUGUGUCUAGAAUAUC CAAGAGACAGGUUUC (SEQ ID NO: 382) |
| ACG_KRAS_30bp_guide_30_11 C flip | KRAS | ACG | 20 | D30D | GGAUCAUAUUCCUCCA CAAAAUGAUUCUGAA (SEQ ID NO: 383) |
| GCG_KRAS_30bp_guide_30_11 T flip | KRAS | GCG | 20 | G13G | GUCUUGCCUACUCCAC CAGCUCCAACUACCA (SEQ ID NO: 384) |
| CCT_KRAS_30bp_guide_30_11 C flip | KRAS | CCU | 20 | A18A | GGUAUCGUCAACGCAC UCUUGCCUACGCCAC (SEQ ID NO: 385) |
| TCG_PPIB_30bp_guide_30_11 T flip | PPIB | UCG | 20 | I18I | GCGGACCCCGCUAUGA GGGCGGCGGCAAGGA (SEQ ID NO: 386) |
| ACG_PPIB_30bp_guide_30_7 C flip | PPIB | ACG | 24 | R7C | GAUAUUCCUCCACAAA AUGAUUCUGAAUUAG (SEQ ID NO: 387) |
| GCG_PPIB_30bp_guide_30_11 T flip | PPIB | GCG | 20 | A19V | GGACGGACCCCUCGAU GAGGGCGGCGGCAAG (SEQ ID NO: 388) |
| CCG_PPIB_30bp_guide_30_11 C flip | PPIB | CCG | 20 | S21S | GGGAAGAAGACCGACC CCGCGAUGAGGGCGG (SEQ ID NO: 389) |
| TCG_SMARCA4_30bp_guide_30_9 T flip | SMARCA4 | UCG | 22 | S85L | GGGUCGUCCUACAUGC CCUUCUCAUGCAUGG (SEQ ID NO: 390) |
| ACG_SMARCA4_30bp_guide_30_11 T flip | SMARCA4 | ACG | 20 | D86D | GAGCGCGGGUCUUCCG ACAUGCCCUUCUCAU (SEQ ID NO: 391) |
| GCG_SMARCA4_30bp_guide_30_11 C flip | SMARCA4 | GCG | 20 | R89C | GUGGUUGUAGCCCGGG UCGUCCGACAUGCCC (SEQ ID NO: 392) |
| CCG_SMARCA4_30bp_guide_30_11 T flip | SMARCA4 | CCG | 20 | P88L | GGUUGUAGCGCUGGUC GUCCGACAUGCCCUU (SEQ ID NO: 393) |

TABLE 22-continued

Guide sequences used for endogenous gene editing

| Name | Targeted gene | Motif | Base flip/ position | Codon change | Spacer sequence |
|---|---|---|---|---|---|
| NRAS_C-flip_guide_30_11 | NRAS | UCC | 20 | I21I | GGGAUUAGCUGCAUUGUCAGUGCGCUUUUCC (SEQ ID NO: 394) |
| NKFB1_T-flip_guide_30_11 | NFKB | ACC | 20 | P33S | GGCCAUCUGUGUUUGAAAUACUUCUGGAUUA (SEQ ID NO: 395) |
| EZH2_T-flip_guide_30_11 | EZH2 | UCA | 20 | F32F | GCAGCUCGUCUUAACCUCUUGAGCUGUCUCA (SEQ ID NO: 396) |
| NF2_T-flip_guide_30_7 | NF2 | ACG | 24 | T21M | GGUGAACUUCUUGGGUUGCUUCCUCUUGAGA (SEQ ID NO: 397) |
| RAF1_T-flip_guide_30_7 | RAF1 | UCC | 24 | P30S | GUUGUAGUAGAGAUGCAGCUGGAGCCAUCAA (SEQ ID NO: 398) |
| STAT3_Y705C-flip_50_17 | STAT3 | UAC | 34 | Y705C | GAAACUUGGUCUUCAGGCAUGGGGCAGCGCUACCUGGGUCAGCUUCAGGAU (SEQ ID NO: 399) |
| STAT3_S727C-flip_30_9 | STAT3 | UCC | 22 | S727F | GUGCGGGGGCACAUCGGCAGGUCAAUGGUAU (SEQ ID NO: 400) |
| STAT1_Y701C-flip_50_17 | STAT1 | UAU | 34 | Y705C | GCAACUCAGUCUUGAUACAUCCAGUUCCUUUAGGGCCAUCAAGUUCCAUUG (SEQ ID NO: 401) |
| STAT1_S727C-flip_30_9 | STAT1 | UCC | 22 | S727F | GCCUCAGGACACAUGGGGAGCAGGUUGUCUG (SEQ ID NO: 402) |
| S33F_CTNNB1_30bp_guide_U-flip_30_7 | CTNNB1 | UCU | 24 | S33F | GAUUCCAUAGUCCAGGUAAGACUGUUGCUGC (SEQ ID NO: 403) |
| S33F_CTNNB1_30bp_guide_U-flip_30_9 | CTNNB1 | UCU | 22 | S33F | GGGAUUCCAUAGUCCAGGUAAGACUGUUGCU (SEQ ID NO: 404) |
| S33F_CTNNB1_30bp_guide_U-flip_30_11 | CTNNB1 | UCU | 20 | S33F | GAUGGAUUCCAUAGUCCAGGUAAGACUGUUG (SEQ ID NO: 405) |
| S33F_CTNNB1_30bp_guide_U-flip_30_13 | CTNNB1 | UCU | 18 | S33F | GGAAUGGAUUCCAUAGUCCAGGUAAGACUGU (SEQ ID NO: 406) |
| H36Y_CTNNB1_30bp_guide_U-flip_30_7 | CTNNB1 | CCA | 24 | H36Y | GCAGAAUUGAUUCCAGAGUCCAGGUAAGACU (SEQ ID NO: 407) |

TABLE 22-continued

Guide sequences used for endogenous gene editing

| Name | Targeted gene | Motif | Base flip/ position | Codon change | Spacer sequence |
|---|---|---|---|---|---|
| H36Y_CTNNB1_30bp_guide_U-flip_30_9 | CTNNB1 | CCA | 22 | H36Y | GACCAGAAUUGAUUCC AGAGUCCAGGUAAGA (SEQ ID NO: 408) |
| H36Y_CTNNB1_30bp_guide_U-flip_30_11 | CTNNB1 | CCA | 20 | H36Y | GGCACCAGAAUUGAUU CCAGAGUCCAGGUAA (SEQ ID NO: 409) |
| H36Y_CTNNB1_30bp_guide_U-flip_30_13 | CTNNB1 | CCA | 18 | H36Y | GUGGCACCAGAAUUGA UUCCAGAGUCCAGGU (SEQ ID NO: 410) |
| S37F_CTNNB1_30bp_guide_U-flip_30_7 | CTNNB1 | UCU | 24 | S37F | GGCACCAUAAUGGAUU CCAGAGUCCAGGUAA (SEQ ID NO: 411) |
| S37F_CTNNB1_30bp_guide_U-flip_30_9 | CTNNB1 | UCU | 22 | S37F | GUGGCACCAUAAUGGA UUCCAGAGUCCAGGU (SEQ ID NO: 412) |
| S37F_CTNNB1_30bp_guide_U-flip_30_11 | CTNNB1 | UCU | 20 | S37F | GAGUGGCACCAUAAUG GAUUCCAGAGUCCAG (SEQ ID NO: 413) |
| S37F_CTNNB1_30bp_guide_U-flip_30_13 | CTNNB1 | UCU | 18 | S37F | GGUAGUGGCACCAUAA UGGAUUCCAGAGUCC (SEQ ID NO: 414) |
| T41I_CTNNB1_30bp_guide_U-flip_30_7 | CTNNB1 | ACC | 24 | T41I | GGCUGUGUUAGUGGCA CCAGAAUGGAUUCCA (SEQ ID NO: 415) |
| T41I_CTNNB1_30bp_guide_U-flip_30_9 | CTNNB1 | ACC | 22 | T41I | GGAGCUGUGUUAGUGG CACCAGAAUGGAUUC (SEQ ID NO: 416) |
| T41I_CTNNB1_30bp_guide_U-flip_30_11 | CTNNB1 | ACC | 20 | T41I | GAGGAGCUGUGUUAGU GGCACCAGAAUGGAU (SEQ ID NO: 417) |
| T41I_CTNNB1_30bp_guide_U-flip_30_13 | CTNNB1 | ACC | 18 | T41I | GGAAGGAGCUGUGUUA GUGGCACCAGAAUGG (SEQ ID NO: 418) |
| P44L_CTNNB1_30bp_guide_U-flip_30_7 | CTNNB1 | CCU | 24 | P44L | GAGAGAAUGAGCUGUG GUAGUGGCACCAGAA (SEQ ID NO: 419) |
| P44L_CTNNB1_30bp_guide_U-flip_30_9 | CTNNB1 | CCU | 22 | P44L | GUCAGAGAAUGAGCUG UGGUAGUGGCACCAG (SEQ ID NO: 420) |
| P44L_CTNNB1_30bp_guide_U-flip_30_11 | CTNNB1 | CCU | 20 | P44L | GACUCAGAGAAUGAGC UGUGGUAGUGGCACC (SEQ ID NO: 421) |

TABLE 22-continued

Guide sequences used for endogenous gene editing

| Name | Targeted gene | Motif | Base flip/ position | Codon change | Spacer sequence |
|---|---|---|---|---|---|
| P44L_CTNNB1_30bp_guide_U-flip_30_13 | CTNNB1 | CCU | 18 | P44L | GCCACUCAGAGAAUGA GCUGUGGUAGUGGCA (SEQ ID NO: 422) |
| P44S_CTNNB1_30bp_guide_U-flip_30_7 | CTNNB1 | UCU | 24 | P44S | GGAGAAGUAGCUGUGG UAGUGGCACCAGAAU (SEQ ID NO: 423) |
| P44S_CTNNB1_30bp_guide_U-flip_30_9 | CTNNB1 | UCU | 22 | P44S | GCAGAGAAGUAGCUGU GGUAGUGGCACCAGA (SEQ ID NO: 424) |
| P44S_CTNNB1_30bp_guide_U-flip_30_11 | CTNNB1 | UCU | 20 | P44S | GCUCAGAGAAGUAGCU GUGGUAGUGGCACCA (SEQ ID NO: 425) |
| P44S_CTNNB1_30bp_guide_U-flip_30_13 | CTNNB1 | UCU | 18 | P44S | GCACUCAGAGAAGUAG CUGUGGUAGUGGCAC (SEQ ID NO: 426) |
| S45F_CTNNB1_30bp_guide_U-flip_30_7 | CTNNB1 | UCU | 24 | S45F | GCUCAGAUAAGGAGCU GUGGUAGUGGCACCA (SEQ ID NO: 427) |
| S45F_CTNNB1_30bp_guide_U-flip_30_9 | CTNNB1 | UCU | 22 | S45F | GCACUCAGAUAAGGAG CUGUGGUAGUGGCAC (SEQ ID NO: 428) |
| S45F_CTNNB1_30bp_guide_U-flip_30_11 | CTNNB1 | UCU | 20 | S45F | GACCACUCAGAUAAGG AGCUGUGGUAGUGGC (SEQ ID NO: 429) |
| S45F_CTNNB1_30bp_guide_U-flip_30_13 | CTNNB1 | UCU | 18 | S45F | GUUACCACUCAGAUAA GGAGCUGUGGUAGUG (SEQ ID NO: 430) |
| TCG_KRAS_30bp_guide_U-flip_30_7 | KRAS | UCG | 24 | L56L | GUGUGUCUAGAAUAUC CAAGAGACAGGUUUC (SEQ ID NO: 431) |
| TCG_KRAS_30bp_guide_U-flip_30_9 | KRAS | UCG | 22 | L56L | GGCUGUGUCUAGAAUA UCCAAGAGACAGGUU (SEQ ID NO: 432) |
| TCG_KRAS_30bp_guide_U-flip_30_11 | KRAS | UCG | 20 | L56L | GCUGCUGUGUCUAGAA UAUCCAAGAGACAGG (SEQ ID NO: 433) |
| TCG_KRAS_30bp_guide_U-flip_30_13 | KRAS | UCG | 18 | L56L | GACCUGCUGUGUCUAG AAUAUCCAAGAGACA (SEQ ID NO: 434) |
| ACG_KRAS_30bp_guide_U-flip_30_7 | KRAS | ACG | 24 | D30D | GAUAUUCUUCCACAAA AUGAUUCUGAAUUAG (SEQ ID NO: 435) |

TABLE 22-continued

Guide sequences used for endogenous gene editing

| Name | Targeted gene | Motif | Base flip/ position | Codon change | Spacer sequence |
|---|---|---|---|---|---|
| ACG_KRAS_30bp_guide_U-flip_30_9 | KRAS | ACG | 22 | D30D | GUCAUAUUCUUCCACA AAAUGAUUCUGAAUU (SEQ ID NO: 436) |
| ACG_KRAS_30bp_guide_U-flip_30_11 | KRAS | ACG | 20 | D30D | GGAUCAUAUUCUUCCA CAAAAUGAUUCUGAA (SEQ ID NO: 437) |
| ACG_KRAS_30bp_guide_U-flip_30_13 | KRAS | ACG | 18 | D30D | GUGGAUCAUAUUCUUC CACAAAAUGAUUCUG (SEQ ID NO: 438) |
| GCG_KRAS_30bp_guide_U-flip_30_7 | KRAS | GCG | 24 | G13G | GGCCUACUCCACCAGC UCCAACUACCACAAG (SEQ ID NO: 439) |
| GCG_KRAS_30bp_guide_U-flip_30_9 | KRAS | GCG | 22 | G13G | GUUGCCUACUCCACCA GCUCCAACUACCACA (SEQ ID NO: 440) |
| GCG_KRAS_30bp_guide_U-flip_30_11 | KRAS | GCG | 20 | G13G | GUCUUGCCUACUCCAC CAGCUCCAACUACCA (SEQ ID NO: 441) |
| GCG_KRAS_30bp_guide_U-flip_30_13 | KRAS | GCG | 18 | G13G | GACUCUUGCCUACUCC ACCAGCUCCAACUAC (SEQ ID NO: 442) |
| CCT_KRAS_30bp_guide_U-flip_30_7 | KRAS | CCU | 24 | A18A | GCGUCAAUGCACUCUU GCCUACGCCACCAGC (SEQ ID NO: 443) |
| CCT_KRAS_30bp_guide_U-flip_30_9 | KRAS | CCU | 22 | A18A | GAUCGUCAAUGCACUC UUGCCUACGCCACCA (SEQ ID NO: 444) |
| CCT_KRAS_30bp_guide_U-flip_30_11 | KRAS | CCU | 20 | A18A | GGUAUCGUCAAUGCAC UCUUGCCUACGCCAC (SEQ ID NO: 445) |
| CCT_KRAS_30bp_guide_U-flip_30_13 | KRAS | CCU | 18 | A18A | GCUGUAUCGUCAAUGC ACUCUUGCCUACGCC (SEQ ID NO: 446) |
| TCG_PPIB_30bp_guide_U-flip_30_7 | PPIB | UCG | 24 | I18I | GCCCCGCUAUGAGGGC GGCGGCAAGGAGCAC (SEQ ID NO: 447) |
| TCG_PPIB30bp_guide_U-flip_30_9 | PPIB | UCG | 22 | I18I | GGACCCCGCUAUGAGG GCGGCGGCAAGGAGC (SEQ ID NO: 448) |
| TCG_PPIB_30bp_guide_U-flip_30_11 | PPIB | UCG | 20 | I18I | GCGGACCCCGCUAUGA GGGCGGCGGCAAGGA (SEQ ID NO: 449) |

TABLE 22-continued

Guide sequences used for endogenous gene editing

| Name | Targeted gene | Motif | Base flip/ position | Codon change | Spacer sequence |
|---|---|---|---|---|---|
| TCG_PPIB_30bp_guide_U-flip_30_13 | PPIB | UCG | 18 | I18I | GGACGGACCCCGCUAU GAGGGCGGCGGCAAG (SEQ ID NO: 450) |
| ACG_PPIB_30bp_guide_U-flip_30_7 | PPIB | ACG | 24 | R7C | GUGUUGCUUUCGGAGA GGCGCAGCAUCCACA (SEQ ID NO: 451) |
| ACG_PPIB_30bp_guide_U-flip_30_9 | PPIB | ACG | 22 | R7C | GCAUGUUGCUUUCGGA GAGGCGCAGCAUCCA (SEQ ID NO: 452) |
| ACG_PPIB_30bp_guide_U-flip_30_11 | PPIB | ACG | 20 | R7C | GUUCAUGUUGCUUUCG GAGAGGCGCAGCAUC (SEQ ID NO: 453) |
| ACG_PPIB_30bp_guide_U-flip_30_13 | PPIB | ACG | 18 | R7C | GCCUUCAUGUUGCUUU CGGAGAGGCGCAGCA (SEQ ID NO: 454) |
| GCG_PPIB_30bp_guide_U-flip_30_7 | PPIB | GCG | 24 | A19V | GGACCCCUCGAUGAGG GCGGCGGCAAGGAGC (SEQ ID NO: 455) |
| GCG_PPIB_30bp_guide_U-flip_30_9 | PPIB | GCG | 22 | A19V | GCGGACCCCUCGAUGA GGGCGGCGGCAAGGA (SEQ ID NO: 456) |
| GCG_PPIB_30bp_guide_U-flip_30_11 | PPIB | GCG | 20 | A19V | GGACGGACCCCUCGAU GAGGGCGGCGGCAAG (SEQ ID NO: 457) |
| GCG_PPIB_30bp_guide_U-flip_30_13 | PPIB | GCG | 18 | A19V | GAAGACGGACCCCUCG AUGAGGGCGGCGGCA (SEQ ID NO: 458) |
| CCG_PPIB_30bp_guide_U-flip_30_7 | PPIB | CCG | 24 | S21S | GGAAGACUGACCCCGC GAUGAGGGCGGCGGC (SEQ ID NO: 459) |
| CCG_PPIB_30bp_guide_U-flip_30_9 | PPIB | CCG | 22 | S21S | GAAGAAGACUGACCCC GCGAUGAGGGCGGCG (SEQ ID NO: 460) |
| CCG_PPIB_30bp_guide_U-flip_30_11 | PPIB | CCG | 20 | S21S | GGGAAGAAGACUGACC CCGCGAUGAGGGCGG (SEQ ID NO: 461) |
| CCG_PPIB_30bp_guide_U-flip_30_13 | PPIB | CCG | 18 | S21S | GCAGGAAGAAGACUGA CCCCGCGAUGAGGGC (SEQ ID NO: 462) |
| TCG_SMARCA4_30bp_guide_U-flip_30_7 | SMARCA4 | UCG | 24 | S85L | GUCGUCCUACAUGCCC UUCUCAUGCAUGGAC (SEQ ID NO: 463) |

TABLE 22-continued

| Guide sequences used for endogenous gene editing | | | | | |
|---|---|---|---|---|---|
| Name | Targeted gene | Motif | Base flip/ position | Codon change | Spacer sequence |
| TCG_SMARCA4_30bp_guide_U-flip_30_9 | SMARCA4 | UCG | 22 | S85L | GGGUCGUCCUACAUGCCCUUCUCAUGCAUGG (SEQ ID NO: 464) |
| TCG_SMARCA4_30bp_guide_U-flip_30_11 | SMARCA4 | UCG | 20 | S85L | GCGGGUCGUCCUACAUGCCCUUCUCAUGCAU (SEQ ID NO: 465) |
| TCG_SMARCA4_30bp_guide_U-flip_30_13 | SMARCA4 | UCG | 18 | S85L | GCGCGGGUCGUCCUACAUGCCCUUCUCAUGC (SEQ ID NO: 466) |
| ACG_SMARCA4_30bp_guide_U-flip_30_7 | SMARCA4 | ACG | 24 | D86D | GCGGGUCUUCCGACAUGCCCUUCUCAUGCAU (SEQ ID NO: 467) |
| ACG_SMARCA4_30bp_guide_U-flip_30_9 | SMARCA4 | ACG | 22 | D86D | GCGCGGGUCUUCCGACAUGCCCUUCUCAUGC (SEQ ID NO: 468) |
| ACG_SMARCA4_30bp_guide_U-flip_30_11 | SMARCA4 | ACG | 20 | D86D | GAGCGCGGGUCUUCCGACAUGCCCUUCUCAU (SEQ ID NO: 469) |
| ACG_SMARCA4_30bp_guide_U-flip_30_13 | SMARCA4 | ACG | 18 | D86D | GGUAGCGCGGGUCUUCCGACAUGCCCUUCUC (SEQ ID NO: 470) |
| GCG_SMARCA4_30bp_guide_U-flip_30_7 | SMARCA4 | GCG | 24 | R89C | GUGUAGCUCGGGUCGUCCGACAUGCCCUUCU (SEQ ID NO: 471) |
| GCG_SMARCA4_30bp_guide_U-flip_30_9 | SMARCA4 | GCG | 22 | R89C | GGUUGUAGCUCGGGUCGUCCGACAUGCCCUU (SEQ ID NO: 472) |
| GCG_SMARCA4_30bp_guide_U-flip_30_11 | SMARCA4 | GCG | 20 | R89C | GUGGUUGUAGCUCGGGUCGUCCGACAUGCCC (SEQ ID NO: 473) |
| GCG_SMARCA4_30bp_guide_U-flip_30_13 | SMARCA4 | GCG | 18 | R89C | GUCUGGUUGUAGCUCGGGUCGUCCGACAUGC (SEQ ID NO: 474) |
| CCG_SMARCA4_30bp_guide_U-flip_30_7 | SMARCA4 | CCG | 24 | P88L | GUAGCGCUGGUCGUCCGACAUGCCCUUCUCA (SEQ ID NO: 475) |
| CCG_SMARCA4_30bp_guide_U-flip_30_9 | SMARCA4 | CCG | 22 | P88L | GUGUAGCGCUGGUCGUCCGACAUGCCCUUCU (SEQ ID NO: 476) |
| CCG_SMARCA4_30bp_guide_U-flip_30_11 | SMARCA4 | CCG | 20 | P88L | GGUUGUAGCGCUGGUCGUCCGACAUGCCCUU (SEQ ID NO: 477) |

TABLE 22-continued

Guide sequences used for endogenous gene editing

| Name | Targeted gene | Motif | Base flip/ position | Codon change | Spacer sequence |
|---|---|---|---|---|---|
| CCG_SMARCA4_30bp_guide_U-flip_30_13 | SMARCA4 | CCG | 18 | P88L | GUGGUUGUAGCGCUGG UCGUCCGACAUGCCC (SEQ ID NO: 478) |
| S33F_CTNNB1_30bp_C-flip_guide_30_7 | CTNNB1 | UCU | 24 | S33F | GAUUCCACAGUCCAGG UAAGACUGUUGCUGC (SEQ ID NO: 479) |
| S33F_CTNNB1_30bp_C-flip_guide_30_9 | CTNNB1 | UCU | 22 | S33F | GGGAUUCCACAGUCCA GGUAAGACUGUUGCU (SEQ ID NO: 480) |
| S33F_CTNNB1_30bp_C-flip_guide_30_11 | CTNNB1 | UCU | 20 | S33F | GAUGGAUUCCACAGUC CAGGUAAGACUGUUG (SEQ ID NO: 481) |
| S33F_CTNNB1_30bp_C-flip_guide_30_13 | CTNNB1 | UCU | 18 | S33F | GGAAUGGAUUCCACAG UCCAGGUAAGACUGU (SEQ ID NO: 482) |
| H36Y_CTNNB1_30bp_C-flip_guide_30_7 | CTNNB1 | CCA | 24 | H36Y | GCAGAAUCGAUUCCAG AGUCCAGGUAAGACU (SEQ ID NO: 483) |
| H36Y_CTNNB1_30bp_C-flip_guide_30_9 | CTNNB1 | CCA | 22 | H36Y | GACCAGAAUCGAUUCC AGAGUCCAGGUAAGA (SEQ ID NO: 484) |
| H36Y_CTNNB1_30bp_C-flip_guide_30_11 | CTNNB1 | CCA | 20 | H36Y | GGCACCAGAAUCGAUU CCAGAGUCCAGGUAA (SEQ ID NO: 485) |
| H36Y_CTNNB1_30bp_C flip_guide_30_13 | CTNNB1 | CCA | 18 | H36Y | GUGGCACCAGAAUCGA UUCCAGAGUCCAGGU (SEQ ID NO: 486) |
| S37F_CTNNB1_30bp_C-flip_guide_30_7 | CTNNB1 | UCU | 24 | S37F | GGCACCACAAUGGAUU CCAGAGUCCAGGUAA (SEQ ID NO: 487) |
| S37F_CTNNB1_30bp_C-flip_guide_30_9 | CTNNB1 | UCU | 22 | S37F | GUGGCACCACAAUGGA UUCCAGAGUCCAGGU (SEQ ID NO: 488) |
| S37F_CTNNB1_30bp_C-flip_guide_30_11 | CTNNB1 | UCU | 20 | S37F | GAGUGGCACCACAAUG GAUUCCAGAGUCCAG (SEQ ID NO: 489) |
| S37F_CTNNB1_30bp_C-flip_guide_30_13 | CTNNB1 | UCU | 18 | S37F | GGUAGUGGCACCACAA UGGAUUCCAGAGUCC (SEQ ID NO: 490) |
| T41I_CTNNB1_30bp_C-flip_guide_30_7 | CTNNB1 | ACC | 24 | T41I | GGCUGUGCUAGUGGCA CCAGAAUGGAUUCCA (SEQ ID NO: 491) |

TABLE 22-continued

Guide sequences used for endogenous gene editing

| Name | Targeted gene | Motif | Base flip/ position | Codon change | Spacer sequence |
|---|---|---|---|---|---|
| T41I_CTNNB1_30bp_C-flip_guide_30_9 | CTNNB1 | ACC | 22 | T41I | GGAGCUGUGCUAGUGG CACCAGAAUGGAUUC (SEQ ID NO: 492) |
| T41I_CTNNB1_30bp_C-flip_guide_30_11 | CTNNB1 | ACC | 20 | T41I | GAGGAGCUGUGCUAGU GGCACCAGAAUGGAU (SEQ ID NO: 493) |
| T41I_CTNNB1_30bp_C-flip_guide_30_13 | CTNNB1 | ACC | 18 | T41I | GGAAGGAGCUGUGCUA GUGGCACCAGAAUGG (SEQ ID NO: 494) |
| P44L_CTNNB1_30bp_C-flip_guide_30_7 | CTNNB1 | CCU | 24 | P44L | GAGAGAACGAGCUGUG GUAGUGGCACCAGAA (SEQ ID NO: 495) |
| P44L_CTNNB1_30bp_C-flip_guide_30_9 | CTNNB1 | CCU | 22 | P44L | GUCAGAGAACGAGCUG UGGUAGUGGCACCAG (SEQ ID NO: 496) |
| P44L_CTNNB1_30bp_C-flip_guide_30_11 | CTNNB1 | CCU | 20 | P44L | GACUCAGAGAACGAGC UGUGGUAGUGGCACC (SEQ ID NO: 497) |
| P44L_CTNNB1_30bp_C-flip_guide_30_13 | CTNNB1 | CCU | 18 | P44L | GCCACUCAGAGAACGA GCUGUGGUAGUGGCA (SEQ ID NO: 498) |
| P44S_CTNNB1_30bp_C-flip_guide_30_7 | CTNNB1 | UCU | 24 | P44S | GGAGAAGCAGCUGUGG UAGUGGCACCAGAAU (SEQ ID NO: 499) |
| P44S_CTNNB1_30bp_C-flip_guide_30_9 | CTNNB1 | UCU | 22 | P44S | GCAGAGAAGCAGCUGU GGUAGUGGCACCAGA (SEQ ID NO: 500) |
| P44S_CTNNB1_30bp_C-flip_guide_30_11 | CTNNB1 | UCU | 20 | P44S | GCUCAGAGAAGCAGCU GUGGUAGUGGCACCA (SEQ ID NO: 501) |
| P44S_CTNNB1_30bp_C-flip_guide_30_13 | CTNNB1 | UCU | 18 | P44S | GCACUCAGAGAAGCAG CUGUGGUAGUGGCAC (SEQ ID NO: 502) |
| S45F_CTNNB1_30bp_C-flip_guide_30_7 | CTNNB1 | UCU | 24 | S45F | GCUCAGACAAGGAGCU GUGGUAGUGGCACCA (SEQ ID NO: 503) |
| S45F_CTNNB1_30bp_C-flip_guide_30_9 | CTNNB1 | UCU | 22 | S45F | GCACUCAGACAAGGAG CUGUGGUAGUGGCAC (SEQ ID NO: 504) |
| S45F_CTNNB1_30bp_C-flip_guide_30_11 | CTNNB1 | UCU | 20 | S45F | GACCACUCAGACAAGG AGCUGUGGUAGUGGC (SEQ ID NO: 505) |

TABLE 22-continued

Guide sequences used for endogenous gene editing

| Name | Targeted gene | Motif | Base flip/ position | Codon change | Spacer sequence |
|---|---|---|---|---|---|
| S45F_CTNNB1_30bp_C-flip_guide_30_13 | CTNNB1 | UCU | 18 | S45F | GUUACCACUCAGACAAGGAGCUGUGGUAGUG (SEQ ID NO: 506) |
| TCG_KRAS_30bp_C-flip_guide_30_7 | KRAS | UCG | 24 | L56L | GUGUGUCCAGAAUAUCCAAGAGACAGGUUUC (SEQ ID NO: 507) |
| TCG_KRAS_30bp_C-flip_guide_30_9 | KRAS | UCG | 22 | L56L | GGCUGUGUCCAGAAUAUCCAAGAGACAGGUU (SEQ ID NO: 508) |
| TCG_KRAS_30bp_C-flip_guide_30_11 | KRAS | UCG | 20 | L56L | GCUGCUGUGUCCAGAAUAUCCAAGAGACAGG (SEQ ID NO: 509) |
| TCG_KRAS_30bp_C-flip_guide_30_13 | KRAS | UCG | 18 | L56L | GACCUGCUGUGUCCAGAAUAUCCAAGAGACA (SEQ ID NO: 510) |
| ACG_KRAS_30bp_C-flip_guide_30_7 | KRAS | ACG | 24 | D30D | GAUAUUCCUCCACAAAAUGAUUCUGAAUUAG (SEQ ID NO: 511) |
| ACG_KRAS_30bp_C-flip_guide_30_9 | KRAS | ACG | 22 | D30D | GUCAUAUUCCUCCACAAAAUGAUUCUGAAUU (SEQ ID NO: 512) |
| ACG_KRAS_30bp_C-flip_guide_30_11 | KRAS | ACG | 20 | D30D | GGAUCAUAUUCCUCCACAAAAUGAUUCUGAA (SEQ ID NO: 513) |
| ACG_KRAS_30bp_C-flip_guide_30_13 | KRAS | ACG | 18 | D30D | GUGGAUCAUAUUCCUCCACAAAAUGAUUCUG (SEQ ID NO: 514) |
| GCG_KRAS_30bp_C-flip_guide_30_7 | KRAS | GCG | 24 | G13G | GGCCUACCCCACCAGCUCCAACUACCACAAG (SEQ ID NO: 515) |
| GCG_KRAS_30bp_C-flip_guide_30_9 | KRAS | GCG | 22 | G13G | GUUGCCUACCCCACCAGCUCCAACUACCACA (SEQ ID NO: 516) |
| GCG_KRAS_30bp_C-flip_guide_30_11 | KRAS | GCG | 20 | G13G | GUCUUGCCUACCCCACCAGCUCCAACUACCA (SEQ ID NO: 517) |
| GCG_KRAS_30bp_C-flip_guide_30_13 | KRAS | GCG | 18 | G13G | GACUCUUGCCUACCCCACCAGCUCCAACUAC (SEQ ID NO: 518) |
| CCT_KRAS_30bp_C-flip_guide_30_7 | KRAS | CCU | 24 | A18A | GCGUCAACGCACUCUUGCCUACGCCACCAGC (SEQ ID NO: 519) |

TABLE 22-continued

| Guide sequences used for endogenous gene editing | | | | | |
|---|---|---|---|---|---|
| Name | Targeted gene | Motif | Base flip/ position | Codon change | Spacer sequence |
| CCT_KRAS_30bp_C-flip_guide_30_9 | KRAS | CCU | 22 | A18A | GAUCGUCAACGCACUC UUGCCUACGCCACCA (SEQ ID NO: 520) |
| CCT_KRAS_30bp_C-flip_guide_30_11 | KRAS | CCU | 20 | A18A | GGUAUCGUCAACGCAC UCUUGCCUACGCCAC (SEQ ID NO: 521) |
| CCT_KRAS_30bp_C-flip_guide_30_13 | KRAS | CCU | 18 | A18A | GCUGUAUCGUCAACGC ACUCUUGCCUACGCC (SEQ ID NO: 522) |
| TCG_PPIB__30bp_C-flip_guide_30_7 | PPIB | UCG | 24 | I18I | GCCCCGCCAUGAGGGC GGCGGCAAGGAGCAC (SEQ ID NO: 523) |
| TCG_PPIB_30bp_C-flip_guide_30_9 | PPIB | UCG | 22 | I18I | GGACCCCGCCAUGAGG GCGGCGGCAAGGAGC (SEQ ID NO: 524) |
| TCG_PPIB_30bp_C-flip_guide_30_11 | PPIB | UCG | 20 | I18I | GCGGACCCCGCCAUGA GGGCGGCGGCAAGGA (SEQ ID NO: 525) |
| TCG_PPIB_30bp_C-flip_guide_30_13 | PPIB | UCG | 18 | I18I | GGACGGACCCCGCCAU GAGGGCGGCGGCAAG (SEQ ID NO: 526) |
| ACG_PPIB_30bp_C-flip_guide_30_7 | PPIB | ACG | 24 | R7C | GUGUUGCCUUCGGAGA GGCGCAGCAUCCACA (SEQ ID NO: 527) |
| ACG_PPIB_30bp_C-flip_guide_30_9 | PPIB | ACG | 22 | R7C | GCAUGUUGCCUUCGGA GAGGCGCAGCAUCCA (SEQ ID NO: 528) |
| ACG_PPIB_30bp_C-flip_guide_30_11 | PPIB | ACG | 20 | R7C | GUUCAUGUUGCCUUCG GAGAGGCGCAGCAUC (SEQ ID NO: 529) |
| ACG_PPIB_30bp_C-flip_guide_30_13 | PPIB | ACG | 18 | R7C | GCCUUCAUGUUGCCUU CGGAGAGGCGCAGCA (SEQ ID NO: 530) |
| GCG_PPIB_30bp_C-flip_guide_30_7 | PPIB | GCG | 24 | A19V | GGACCCCCCGAUGAGG GCGGCGGCAAGGAGC (SEQ ID NO: 531) |
| GCG_PPIB_30bp_C-flip_guide_30_9 | PPIB | GCG | 22 | A19V | GCGGACCCCCCGAUGA GGGCGGCGGCAAGGA (SEQ ID NO: 532) |
| GCG_PPIB_30bp_C-flip_guide_30_11 | PPIB | GCG | 20 | A19V | GGACGGACCCCCCGAU GAGGGCGGCGGCAAG (SEQ ID NO: 533) |

TABLE 22-continued

| Guide sequences used for endogenous gene editing | | | | | |
|---|---|---|---|---|---|
| Name | Targeted gene | Motif | Base flip/ position | Codon change | Spacer sequence |
| GCG_PPIB_30bp_C-flip_guide_30_13 | PPIB | GCG | 18 | A19V | GAAGACGGACCCCCCG AUGAGGGCGGCGGCA (SEQ ID NO: 534) |
| CCG_PPIB_30bp_C-flip_guide_30_7 | PPIB | CCG | 24 | S21S | GGAAGACCGACCCCGC GAUGAGGGCGGCGGC (SEQ ID NO: 535) |
| CCG_PPIB_30bp_C-flip_guide_30_9 | PPIB | CCG | 22 | S21S | GAAGAAGACCGACCCC GCGAUGAGGGCGGCG (SEQ ID NO: 536) |
| CCG_PPIB_30bp_C-flip_guide_30_11 | PPIB | CCG | 20 | S21S | GGGAAGAAGACCGACC CCGCGAUGAGGGCGG (SEQ ID NO: 537) |
| CCG_PPIB_30bp_C-flip_guide_30_13 | PPIB | CCG | 18 | S21S | GCAGGAAGAAGACCGA CCCCGCGAUGAGGGC (SEQ ID NO: 538) |
| TCG_SMARCA4_30bp_C-flip_guide_30_7 | SMARCA4 | UCG | 24 | S85L | GUCGUCCCACAUGCCC UUCUCAUGCAUGGAC (SEQ ID NO: 539) |
| TCG_SMARCA4_30bp_C-flip_guide_30_9 | SMARCA4 | UCG | 22 | S85L | GGGUCGUCCCACAUGC CCUUCUCAUGCAUGG (SEQ ID NO: 540) |
| TCG_SMARCA4_30bp_C-flip_guide_30_11 | SMARCA4 | UCG | 20 | S85L | GCGGGUCGUCCCACAU GCCCUUCUCAUGCAU (SEQ ID NO: 541) |
| TCG_SMARCA4_30bp_C-flip_guide_30_13 | SMARCA4 | UCG | 18 | S85L | GCGCGGGUCGUCCCAC AUGCCCUUCUCAUGC (SEQ ID NO: 542) |
| ACG_SMARCA4_30bp_C-flip_guide_30_7 | SMARCA4 | ACG | 24 | D86D | GCGGGUCCUCCGACAU GCCCUUCUCAUGCAU (SEQ ID NO: 543) |
| ACG_SMARCA4_30bp_C-flip_guide_30_9 | SMARCA4 | ACG | 22 | D86D | GCGCGGGUCCUCCGAC AUGCCCUUCUCAUGC (SEQ ID NO: 544) |
| ACG_SMARCA4_30bp_C-flip_guide_30_11 | SMARCA4 | ACG | 20 | D86D | GAGCGCGGGUCCUCCG ACAUGCCCUUCUCAU (SEQ ID NO: 545) |
| ACG_SMARCA4_30bp_C-flip_guide_30_13 | SMARCA4 | ACG | 18 | D86D | GGUAGCGCGGGUCCUC CGACAUGCCCUUCUC (SEQ ID NO: 546) |
| GCG_SMARCA4_30bp_C-flip_guide_30_7 | SMARCA4 | GCG | 24 | R89C | GUGUAGCCCGGGUCGU CCGACAUGCCCUUCU (SEQ ID NO: 547) |

TABLE 22-continued

Guide sequences used for endogenous gene editing

| Name | Targeted gene | Motif | Base flip/ position | Codon change | Spacer sequence |
|---|---|---|---|---|---|
| GCG_SMARCA4_30bp_C-flip_guide_30_9 | SMARCA4 | GCG | 22 | R89C | GGUUGUAGCCCGGGUCGUCCGACAUGCCCUU (SEQ ID NO: 548) |
| GCG_SMARCA4_30bp_C-flip_guide_30_11 | SMARCA4 | GCG | 20 | R89C | GUGGUUGUAGCCCGGGUCGUCCGACAUGCCC (SEQ ID NO: 549) |
| GCG_SMARCA4_30bp_C-flip_guide_30_13 | SMARCA4 | GCG | 18 | R89C | GUCUGGUUGUAGCCCGGGUCGUCCGACAUGC (SEQ ID NO: 550) |
| CCG_SMARCA4_30bp_C-flip_guide_30_7 | SMARCA4 | CCG | 24 | P88L | GUAGCGCCGGUCGUCCGACAUGCCCUUCUCA (SEQ ID NO: 551) |
| CCG_SMARCA4_30bp_C-flip_guide_30_9 | SMARCA4 | CCG | 22 | P88L | GUGUAGCGCCGGUCGUCCGACAUGCCCUUCU (SEQ ID NO: 552) |
| CCG_SMARCA4_30bp_C-flip_guide_30_11 | SMARCA4 | CCG | 20 | P88L | GGUUGUAGCGCCGGUCGUCCGACAUGCCCUU (SEQ ID NO: 553) |
| CCG_SMARCA4_30bp_C-flip_guide_30_13 | SMARCA4 | CCG | 18 | P88L | GUGGUUGUAGCGCCGGUCGUCCGACAUGCCC (SEQ ID NO: 554) |
| NRAS_30bp_C-flip_guide_30_3 | NRAS | UCC | 28 | I21I | GUGCAUUGUCAGUGCGCUUUUCCCAACACCA (SEQ ID NO: 555) |
| NRAS_30bp_C-flip_guide_30_5 | NRAS | UCC | 26 | I21I | GGCUGCAUUGUCAGUGCGCUUUUCCCAACAC (SEQ ID NO: 556) |
| NRAS_30bp_C-flip_guide_30_7 | NRAS | UCC | 24 | I21I | GUAGCUGCAUUGUCAGUGCGCUUUUCCCAAC (SEQ ID NO: 557) |
| NRAS_30bp_C-flip_guide_30_9 | NRAS | UCC | 22 | I21I | GAUUAGCUGCAUUGUCAGUGCGCUUUUCCCA (SEQ ID NO: 558) |
| NRAS_30bp_C-flip_guide_30_11 | NRAS | UCC | 20 | I21I | GGGAUUAGCUGCAUUGUCAGUGCGCUUUUCC (SEQ ID NO: 559) |
| NKFB1_30bp_C-flip_guide_30_3 | NKFB1 | ACC | 28 | P33S | GUGCUUGAAAUACUUCUGGAUUAAAUAUUGU (SEQ ID NO: 560) |
| NKFB1_30bp_C-flip_guide_30_5 | NKFB1 | ACC | 26 | P33S | GUGUGCUUGAAAUACUUCUGGAUUAAAUAUU (SEQ ID NO: 561) |
| NKFB1_30bp_C-flip_guide_30_7 | NKFB1 | ACC | 24 | P33S | GUCUGUGCUUGAAAUACUUCUGGAUUAAAUA (SEQ ID NO: 562) |

TABLE 22-continued

Guide sequences used for endogenous gene editing

| Name | Targeted gene | Motif | Base flip/ position | Codon change | Spacer sequence |
|---|---|---|---|---|---|
| NKFB1_30bp_C-flip_guide_30_9 | NKFB1 | ACC | 22 | P33S | GCAUCUGUGCUUGAAA UACUUCUGGAUUAAA (SEQ ID NO: 563) |
| NKFB1_30bp_C-flip_guide_30_11 | NKFB1 | ACC | 20 | P33S | GGCCAUCUGUGCUUGA AAUACUUCUGGAUUA (SEQ ID NO: 564) |
| EZH2_30bp_C-flip_guide_30_3 | EZH2 | UCA | 28 | F32F | GCUCAACCUCUUGAGC UGUCUCAGUCGCAUG (SEQ ID NO: 565) |
| EZH2_30bp_C-flip_guide_30_5 | EZH2 | UCA | 26 | F32F | GGUCUCAACCUCUUGA GCUGUCUCAGUCGCA (SEQ ID NO: 566) |
| EZH2_30bp_C-flip_guide_30_7 | EZH2 | UCA | 24 | F32F | GUCGUCUCAACCUCUU GAGCUGUCUCAGUCG (SEQ ID NO: 567) |
| EZH2_30bp_C-flip_guide_30_9 | EZH2 | UCA | 22 | F32F | GGCUCGUCUCAACCUC UUGAGCUGUCUCAGU (SEQ ID NO: 568) |
| EZH2_30bp_C-flip_guide_30_11 | EZH2 | UCA | 20 | F32F | GCAGCUCGUCUCAACC UCUUGAGCUGUCUCA (SEQ ID NO: 569) |
| NF2_30bp_C-flip_guide_30_3 | NF2 | ACG | 28 | T21M | GACCUCUUGGGUUGCU UCCUCUUGAGAGAGC (SEQ ID NO: 570) |
| NF2_30bp_C-flip_guide_30_5 | NF2 | ACG | 26 | T21M | GGAACCUCUUGGGUUG CUUCCUCUUGAGAGA (SEQ ID NO: 571) |
| NF2_30bp_C-flip_guide_30_7 | NF2 | ACG | 24 | T21M | GGUGAACCUCUUGGGU UGCUUCCUCUUGAGA (SEQ ID NO: 572) |
| NF2_30bp_C-flip_guide_30_9 | NF2 | ACG | 22 | T21M | GCGGUGAACCUCUUGG GUUGCUUCCUCUUGA (SEQ ID NO: 573) |
| NF2_30bp_C-flip_guide_30_11 | NF2 | ACG | 20 | T21M | GCACGGUGAACCUCUU GGGUUGCUUCCUCUU (SEQ ID NO: 574) |
| RAF1_30bp_C-flip_guide_30_3 | RAF1 | UCC | 28 | P30S | GAGCAGAGAUGCAGCU GGAGCCAUCAAACAC (SEQ ID NO: 575) |
| RAF1_30bp_C-flip_guide_30_5 | RAF1 | UCC | 26 | P30S | GGUAGCAGAGAUGCAG CUGGAGCCAUCAAAC (SEQ ID NO: 576) |

TABLE 22-continued

| Guide sequences used for endogenous gene editing | | | | | |
|---|---|---|---|---|---|
| Name | Targeted gene | Motif | Base flip/ position | Codon change | Spacer sequence |
| RAF1_30bp_C-flip_guide_30_7 | RAF1 | UCC | 24 | P30S | GUUGUAGCAGAGAUGC AGCUGGAGCCAUCAA (SEQ ID NO: 577) |
| RAF1_30bpC-flip_guide_30_9 | RAF1 | UCC | 22 | P30S | GUAUUGUAGCAGAGAU GCAGCUGGAGCCAUC (SEQ ID NO: 578) |
| RAF1_30bp_C-flip_guide_30_11 | RAF1 | UCC | 20 | P30S | GACUAUUGUAGCAGAG AUGCAGCUGGAGCCA (SEQ ID NO: 579) |
| NRAS_30bp_T-flip_guide_30_3 | NRAS | UCC | 28 | I21I | GUGUAUUGUCAGUGCG CUUUUCCCAACACCA (SEQ ID NO: 580) |
| NRAS_30bp_T-flip_guide_30_5 | NRAS | UCC | 26 | I21I | GGCUGUAUUGUCAGUG CGCUUUUCCCAACAC (SEQ ID NO: 581) |
| NRAS_30bp_T-flip_guide_30_7 | NRAS | UCC | 24 | I21I | GUAGCUGUAUUGUCAG UGCGCUUUUCCCAAC (SEQ ID NO: 582) |
| NRAS_30bp_T-flip_guide_30_9 | NRAS | UCC | 22 | I21I | GAUUAGCUGUAUUGUC AGUGCGCUUUUCCCA (SEQ ID NO: 583) |
| NRAS_30bp_T-flip_guide_30_11 | NRAS | UCC | 20 | I21I | GGGAUUAGCUGUAUUG UCAGUGCGCUUUUCC (SEQ ID NO: 584) |
| NKFB1_30bp_T-flip_guide_30_3 | NKFB1 | ACC | 28 | P33S | GUGUUUGAAAUACUUC UGGAUUAAAUAUUGU (SEQ ID NO: 585) |
| NKFB1_30bp_T-flip_guide_30_5 | NKFB1 | ACC | 26 | P33S | GUGUGUUUGAAAUACU UCUGGAUUAAAUAUU (SEQ ID NO: 586) |
| NKFB1_30bp_T-flip_guide_30_7 | NKFB1 | ACC | 24 | P33S | GUCUGUGUUUGAAAUA CUUCUGGAUUAAAUA (SEQ ID NO: 587) |
| NKFB1_30bp_T-flip_guide_30_9 | NKFB1 | ACC | 22 | P33S | GCAUCUGUGUUUGAAA UACUUCUGGAUUAAA (SEQ ID NO: 588) |
| NKFB1_30bp_T-flip_guide_30_11 | NKFB1 | ACC | 20 | P33S | GGCCAUCUGUGUUUGA AAUACUUCUGGAUUA (SEQ ID NO: 589) |
| EZH2_30bp_T-flip_guide_30_3 | EZH2 | UCA | 28 | F32F | GCUUAACCUCUUGAGC UGUCUCAGUCGCAUG (SEQ ID NO: 590) |

TABLE 22-continued

Guide sequences used for endogenous gene editing

| Name | Targeted gene | Motif | Base flip/ position | Codon change | Spacer sequence |
|---|---|---|---|---|---|
| EZH2_30bp_T-flip_guide_30_5 | EZH2 | UCA | 26 | F32F | GGUCUUAACCUCUUGA GCUGUCUCAGUCGCA (SEQ ID NO: 591) |
| EZH2_30bp_T-flip_guide_30_7 | EZH2 | UCA | 24 | F32F | GUCGUCUUAACCUCUU GAGCUGUCUCAGUCG (SEQ ID NO: 592) |
| EZH2_30bp_T-flip_guide_30_9 | EZH2 | UCA | 22 | F32F | GGCUCGUCUUAACCUC UUGAGCUGUCUCAGU (SEQ ID NO: 593) |
| EZH2_30bpT-flip_guide_30_11 | EZH2 | UCA | 20 | F32F | GCAGCUCGUCUUAACC UCUUGAGCUGUCUCA (SEQ ID NO: 594) |
| NF2_30bp_T-flip_guide_30_3 | NF2 | ACG | 28 | T21M | GACUUCUUGGGUUGCU UCCUCUUGAGAGAGC (SEQ ID NO: 595) |
| NF2_30bp_T-flip_guide_30_5 | NF2 | ACG | 26 | T21M | GGAACUUCUUGGGUUG CUUCCUCUUGAGAGA (SEQ ID NO: 596) |
| NF2_30bp_T-flip_guide_30_7 | NF2 | ACG | 24 | T21M | GGUGAACUUCUUGGGU UGCUUCCUCUUGAGA (SEQ ID NO: 597) |
| NF2_30bp_T-flip_guide_30_9 | NF2 | ACG | 22 | T21M | GCGGUGAACUUCUUGG GUUGCUUCCUCUUGA (SEQ ID NO: 598) |
| NF2_30bp_T-flip_guide_30_11 | NF2 | ACG | 20 | T21M | GCACGGUGAACUUCUU GGGUUGCUUCCUCUU (SEQ ID NO: 599) |
| RAF1_30bp_T-flip_guide_30_3 | RAF1 | UCC | 28 | P30S | GAGUAGAGAUGCAGCU GGAGCCAUCAAACAC (SEQ ID NO: 600) |
| RAF1_30bp_T-flip_guide_30_5 | RAF1 | UCC | 26 | P30S | GGUAGUAGAGAUGCAG CUGGAGCCAUCAAAC (SEQ ID NO: 601) |
| RAF1_30bp_T-flip_guide_30_7 | RAF1 | UCC | 24 | P30S | GUUGUAGUAGAGAUGC AGCUGGAGCCAUCAA (SEQ ID NO: 602) |
| RAF1_30bp_T-flip_guide_30_9 | RAF1 | UCC | 22 | P30S | GUAUUGUAGUAGAGAU GCAGCUGGAGCCAUC (SEQ ID NO: 603) |
| RAF1_30bp_T-flip_guide_30_11 | RAF1 | UCC | 20 | P30S | GACUAUUGUAGUAGAG AUGCAGCUGGAGCCA (SEQ ID NO: 604) |

TABLE 23

Guide sequences used for synthetic target editing

| Name | Targeted gene | Motif | Base flip/ position | Codon change | Spacer sequence |
|---|---|---|---|---|---|
| NM_000016.5_C-flip_guide | ACADM | ACA | C/7 | H67Y | GUAUCAUCUUCUGCAGCCACUGGGAUGAUUU (SEQ ID NO: 605) |
| NM_000018.3_C-flip_guide | ACADVL | GCG | C/9 | A283V | GUCUCCACCCCAAAAGCUGUGAUCUUCUCCU (SEQ ID NO: 606) |
| NM_000071.2_C-flip_guide | CBS | GCG | C/9 | R109C | GGAACUCACCCUUGGCCAAGAGCUCACACUU (SEQ ID NO: 607) |
| NM_000138.4_C-flip_guide | FBN1 | GCG | C/5 | R1408C | GGAGCCCUCAUCAAGGUCUGUACAAGUGAAG (SEQ ID NO: 608) |
| NM_000141.4_C-flip_guide | FGFR2 | CCC | C/7 | P267S | GCUGUGGCGGCAUUUGCCGGCAGUCCGGCUU (SEQ ID NO: 609) |
| NM_000152.4_C-flip_guide | GAA | CCC | C/7 | P552L | GGCCUGGCGGGUCCCCCCAACCACCCCAGGC (SEQ ID NO: 610) |
| NM_000341.3_C-flip_guide | SLC3A1 | ACG | C/7 | T467M | GAGAAGCCUGUUCAUCACGUUGACAUACUGA (SEQ ID NO: 611) |
| NM_000375.2_C-flip_guide | UROS | ACG | C/9 | R73C | GCUCCAAACCUAACUCUGCUGCUUCCACUGC (SEQ ID NO: 612) |
| NM_000431.3_C-flip_guide | MVK | ACA | C/9 | T268I | GUGGCAUCUCUUGAGGUCAGGAGGGGGGCCA (SEQ ID NO: 613) |
| NM_000551.3_C-flip_guide | VHL | CCG | C/7 | P158L | GUCUUUCCGAGUAUACACUGGCAGUGUGAUA (SEQ ID NO: 614) |
| NM_001256850.1_C-flip_guide | TTN | ACG | C/9 | R30071C | GCUUUCCACCUGGGCCAGGGGAAUCAAGCAC (SEQ ID NO: 615) |
| NM_002397.4_C-flip_guide | MEF2C | ACG | C/9 | T1M | GUUCUCCCCCUAGUCCCCGUUUUUCUUCUCU (SEQ ID NO: 616) |
| NM_002474.2_C-flip_guide | MYH11 | CCG | C/9 | P1264L | GUGGACUGCCGCUCCUGCACCUGCGCCUCCA (SEQ ID NO: 617) |
| NM_002834.4_C-flip_guide | PTPN11 | CCU | C/9 | L285F | GAUGAUCAACGGGCAGGAUGUUUUUAUAUCU (SEQ ID NO: 618) |
| NM_004004.5_C-flip_guide | GJB2 | ACG | C/5 | R77W | GGCCCCUAGCCGGAUGUGGGAGAUGGGGAAG (SEQ ID NO: 619) |
| NM_004572.3_C-flip_guide | PKP2 | CCG | C/9 | R796C | GUGUGUAACCGGCAGAGGCUGUAGUUUCAAU (SEQ ID NO: 620) |
| NM_005609.3_C-flip_guide | PYGM | GCG | C/9 | R798W | GCCGCGUCCCCUCUCUUGGGUUCUUGUACAA (SEQ ID NO: 621) |
| NM_005633.3_C-flip_guide | SOS1 | ACG | C/9 | T269M | GCAUCUGUCCUUUCUACUGUAUCUUCUAUAU (SEQ ID NO: 622) |
| NM_014139.2_C-flip_guide | SCN11A | CCG | C/9 | P396L | GCAACAGCCCGGGUUAAGUUAAUCAGGUAGA (SEQ ID NO: 623) |

TABLE 23-continued

| Guide sequences used for synthetic target editing | | | | | |
|---|---|---|---|---|---|
| Name | Targeted gene | Motif | Base flip/ position | Codon change | Spacer sequence |
| NM_014874.3_C-flip_guide | MFN2 | CCG | C/9 | P76L | GCAACAGCCCGGGUUAAG UUAAUCAGGUAGA (SEQ ID NO: 624) |
| NM_015559.2_C-flip_guide | SETBP1 | ACU | C/7 | T871I | GGUCCCACUGCCGCUGUC GCUGGGGAUCGUC (SEQ ID NO: 625) |
| NM_020630.4_C-flip_guide | RET | CCG | C/5 | R620C | GUCGCCGAAGCACUUCUC CUCCUCAGGGAAG (SEQ ID NO: 626) |
| NM_000016.5_F_30bp_C-flip_guide_30_5 | ACADM | ACA | C/5 | H67Y | GUCAUCUUCUGCAGCCAC UGGGAUGAUUUCC (SEQ ID NO: 627) |
| NM_000016.5_F_30bp_C-flip_guide_30_7 | ACADM | ACA | C/7 | H67Y | GUAUCAUCUUCUGCAGCC ACUGGGAUGAUUU (SEQ ID NO: 628) |
| NM_000016.5_F_30bp_C-flip_guide_30_9 | ACADM | ACA | C/9 | H67Y | GUUUAUCAUCUUCUGCAG CCACUGGGAUGAU (SEQ ID NO: 629) |
| NM_000018.3_F_30bp_C-flip_guide_30_5 | ACADVL | GCG | C/5 | A283V | GCACCCCAAAAGCUGUGA UCUUCUCCUUCAC (SEQ ID NO: 630) |
| NM_000018.3_F_30bp_C-flip_guide_30_7 | ACADVL | GCG | C/7 | A283V | GUCCACCCCAAAAGCUGU GAUCUUCUCCUUC (SEQ ID NO: 631) |
| NM_000018.3_F_30bp_C-flip_guide_30_9 | ACADVL | GCG | C/9 | A283V | GUCUCCACCCCAAAAGCU GUGAUCUUCUCCU (SEQ ID NO: 632) |
| NM_000071.2_F_30bp_C-flip_guide_30_5 | CBS | GCG | C/5 | R109C | GUCACCCUUGGCCAAGAG CUCACACUUCAGG (SEQ ID NO: 633) |
| NM_000071.2_F_30bp_C-flip_guide_30_7 | CBS | GCG | C/7 | R109C | GACUCACCCUUGGCCAAG AGCUCACACUUCA (SEQ ID NO: 634) |
| NM_000071.2_F_30bp_C-flip_guide_30_9 | CBS | GCG | C/9 | R109C | GGAACUCACCCUUGGCCA AGAGCUCACACUU (SEQ ID NO: 635) |
| NM_000138.4_F_30bp_C-flip_guide_30_5 | FBN1 | GCG | C/5 | R1408C | GGAGCCCUCAUCAAGGUC UGUACAAGUGAAG (SEQ ID NO: 636) |
| NM_000138.4_F_30bp_C-flip_guide_30_7 | FBN1 | GCG | C/7 | R1408C | GCAGAGCCCUCAUCAAGG uCUGUACAAGUGA (SEQ ID NO: 637) |
| NM_000138.4_F_30bp_C-flip_guide_30_9 | FBN1 | GCG | C/9 | R1408C | GCUCAGAGCCCUCAUCAA GGUCUGUACAAGU (SEQ ID NO: 638) |
| NM_000141.4_F_30bp_C-flip_guide_30_5 | FGFR2 | CCC | C/5 | P267S | GGUGGCGGCAUUUGCCGG CAGUCCGGCUUGG (SEQ ID NO: 639) |
| NM_000141.4_F_30bp_C-flip_guide_30_7 | FGFR2 | CCC | C/7 | P267S | GCUGUGGCGGCAUUUGCC GGCAGUCCGGCUU (SEQ ID NO: 640) |
| NM_000141.4_F_30bp_C-flip_guide_30_9 | FGFR2 | CCC | C/9 | P267S | GCACUGUGGCGGCAUUUG CCGGCAGUCCGGC (SEQ ID NO: 641) |

TABLE 23-continued

Guide sequences used for synthetic target editing

| Name | Targeted gene | Motif | Base flip/ position | Codon change | Spacer sequence |
|---|---|---|---|---|---|
| NM_000152.4_F_30bp_C-flip_guide_30_5 | GAA | CCC | C/5 | P552L | GCUGGCGGGUCCCCCCAA CCACCCCAGGCAC (SEQ ID NO: 642) |
| NM_000152.4_F_30bp_C-flip_guide_30_7 | GAA | CCC | C/7 | P552L | GGCCUGGCGGGUCCCCCC AACCACCCCAGGC (SEQ ID NO: 643) |
| NM_000152.4_F_30bp_C-flip_guide_30_9 | GAA | CCC | C/9 | P552L | GCCGCCUGGCGGGUCCCC CCAACCACCCCAG (SEQ ID NO: 644) |
| NM_000341.3_F_30bp_C-flip_guide_30_5 | SLC3A1 | ACG | C/5 | T467M | GAAGCCUGUUCAUCACGU UGACAUACUGAUU (SEQ ID NO: 645) |
| NM_000341.3_F_30bp_C-flip_guide_30_7 | SLC3A1 | ACG | C/7 | T467M | GAGAAGCCUGUUCAUCAC GUUGACAUACUGA (SEQ ID NO: 646) |
| NM_000341.3_F_30bp_C-flip_guide_30_9 | SLC3A1 | ACG | C/9 | T467M | GAAAGAAGCCUGUUCAUC ACGUUGACAUACU (SEQ ID NO: 647) |
| NM_000375.2_F_30bp_C-flip_guide_30_5 | UROS | ACG | C/5 | R73C | GAAACCUAACUCUGCUGC UUCCACUGCUCUG (SEQ ID NO: 648) |
| NM_000375.2_F_30bp_C-flip_guide_30_7 | UROS | ACG | C/7 | R73C | GCCAAACCUAACUCUGCU GCUUCCACUGCUC (SEQ ID NO: 649) |
| NM_000375.2_F_30bp_C-flip_guide_30_9 | UROS | ACG | C/9 | R73C | GCUCCAAACCUAACUCUG CUGCUUCCACUGC (SEQ ID NO: 650) |
| NM_000431.3_F_30bp_C-flip_guide_30_5 | MVK | ACA | C/5 | T268I | GAUCUCUUGAGGUCAGGA GGGGGGCCACGAU (SEQ ID NO: 651) |
| NM_000431.3_F_30bp_C-flip_guide_30_7 | MVK | ACA | C/7 | T268I | GGCAUCUCUUGAGGUCAG GAGGGGGGCCACG (SEQ ID NO: 652) |
| NM_000431.3_F_30bp_C-flip_guide_30_9 | MVK | ACA | C/9 | T268I | GUGGCAUCUCUUGAGGUC AGGAGGGGGGCCA (SEQ ID NO: 653) |
| NM_000551.3_F_30bp_C-flip_guide_30_5 | VHL | CCG | C/5 | P158L | GUUUCCGAGUAUACACUG GCAGUGUGAUAUU (SEQ ID NO: 654) |
| NM_000551.3_F_30bp_C-flip_guide_30_7 | VHL | CCG | C/7 | P158L | GUCUUUCCGAGUAUACAC UGGCAGUGUGAUA (SEQ ID NO: 655) |
| NM_000551.3_F_30bp_C-flip_guide_30_9 | VHL | CCG | C/9 | P158L | GGCUCUUUCCGAGUAUAC ACUGGCAGUGUGA (SEQ ID NO: 656) |
| NM_001256850.1_F_30bp_C-flip_guide_30_5 | TTN | ACG | C/5 | R30071C | GCCACCUGGGCCAGGGGA AUCAAGCACUUUG (SEQ ID NO: 657) |
| NM_001256850.1_F_30bp_C-flip_guide_30_7 | TTN | ACG | C/7 | R30071C | GUUCCACCUGGGCCAGGG GAAUCAAGCACUU (SEQ ID NO: 658) |
| NM_001256850.1_F_30bp_C-flip_guide_30_9 | TTN | ACG | C/9 | R30071C | GCUUUCCACCUGGGCCAG GGGAAUCAAGCAC (SEQ ID NO: 659) |

TABLE 23-continued

Guide sequences used for synthetic target editing

| Name | Targeted gene | Motif | Base flip/ position | Codon change | Spacer sequence |
|---|---|---|---|---|---|
| NM_002397.4_F_30bp_C-flip_guide_30_5 | MEF2C | ACG | C/5 | T1M | GCCCCCUAGUCCCCGUUUUUCUUCUCUCUCU (SEQ ID NO: 660) |
| NM_002397.4_F_30bp_C-flip_guide_30_7 | MEF2C | ACG | C/7 | T1M | GCUCCCCCUAGUCCCCGUUUUUCUUCUCUCU (SEQ ID NO: 661) |
| NM_002397.4_F_30bp_C-flip_guide_30_9 | MEF2C | ACG | C/9 | T1M | GUUCUCCCCCUAGUCCCCGUUUUUCUUCUCU (SEQ ID NO: 662) |
| NM_002474.2_F_30bp_C-flip_guide_30_5 | MYH11 | CCG | C/5 | P1264L | GCUGCCGCUCCUGCACCUGCGCCUCCAGCUU (SEQ ID NO: 663) |
| NM_002474.2_F_30bp_C-flip_guide_30_7 | MYH11 | CCG | C/7 | P1264L | GGACUGCCGCUCCUGCACCUGCGCCUCCAGC (SEQ ID NO: 664) |
| NM_002474.2_F_30bp_C-flip_guide_30_9 | MYH11 | CCG | C/9 | P1264L | GUGGACUGCCGCUCCUGCACCUGCGCCUCCA (SEQ ID NO: 665) |
| NM_002834.4_F_30bp_C-flip_guide_30_5 | PTPN11 | CCU | C/5 | L285F | GUCAACGGGCAGGAUGUUUUUAUAUCUAUUU (SEQ ID NO: 666) |
| NM_002834.4_F_30bp_C-flip_guide_30_7 | PTPN11 | CCU | C/7 | L285F | GGAUCAACGGGCAGGAUGUUUUUAUAUCUAU (SEQ ID NO: 667) |
| NM_002834.4_F_30bp_C-flip_guide_30_9 | PTPN11 | CCU | C/9 | L285F | GAUGAUCAACGGGCAGGAUGUUUUUAUAUCU (SEQ ID NO: 668) |
| NM_004004.5_F_30bp_C-flip_guide_30_5 | GJB2 | ACG | C/5 | R77W | GGCCCCUAGCCGGAUGUGGGAGAUGGGGAAG (SEQ ID NO: 669) |
| NM_004004.5_F_30bp_C-flip_guide_30_7 | GJB2 | ACG | C/7 | R77W | GGGGCCCCUAGCCGGAUGUGGGAGAUGGGGA (SEQ ID NO: 670) |
| NM_004004.5_F_30bp_C-flip_guide_30_9 | GJB2 | ACG | C/9 | R77W | GCAGGGCCCCUAGCCGGAUGUGGGAGAUGGG (SEQ ID NO: 671) |
| NM_004572.3_F_30bp_C-flip_guide_30_5 | PKP2 | CCG | C/5 | R796C | GUAACCGGCAGAGGCUGUAGUUUCAAUGAGA (SEQ ID NO: 672) |
| NM_004572.3_F_30bp_C-flip_guide_30_7 | PKP2 | CCG | C/7 | R796C | GUGUAACCGGCAGAGGCUGUAGUUUCAAUGA (SEQ ID NO: 673) |
| NM_004572.3_F_30bp_C-flip_guide_30_9 | PKP2 | CCG | C/9 | R796C | GUGUGUAACCGGCAGAGGCUGUAGUUUCAAU (SEQ ID NO: 674) |
| NM_005609.3_F_30bp_C-flip_guide_30_5 | PYGM | GCG | C/5 | R798W | GGUCCCCUCUCUUGGGUUCUUGUACAAGGCG (SEQ ID NO: 675) |
| NM_005609.3_F_30bp_C-flip_guide_30_7 | PYGM | GCG | C/7 | R798W | GGCGUCCCCUCUCUUGGGUUCUUGUACAAGG (SEQ ID NO: 676) |
| NM_005609.3_F_30bp_C-flip_guide_30_9 | PYGM | GCG | C/9 | R798W | GCCGCGUCCCCUCUCUUGGGUUCUUGUACAA (SEQ ID NO: 677) |

TABLE 23-continued

| Name | Targeted gene | Motif | Base flip/ position | Codon change | Spacer sequence |
|---|---|---|---|---|---|
| Guide sequences used for synthetic target editing | | | | | |
| NM_005633.3_F_30bp_C-flip_guide_30_5 | SOS1 | ACG | C/5 | T269M | GUGUCCUUUCUACUGUAUCUUCUAUAUGGCC (SEQ ID NO: 678) |
| NM_005633.3_F_30bp_C-flip_guide_30_7 | SOS1 | ACG | C/7 | T269M | GUCUGUCCUUUCUACUGUAUCUUCUAUAUGG (SEQ ID NO: 679) |
| NM_005633.3_F_30bp_C-flip_guide_30_9 | SOS1 | ACG | C/9 | T269M | GCAUCUGUCCUUUCUACUGUAUCUUCUAUAU (SEQ ID NO: 680) |
| NM_014139.2_F_30bp_C-flip_guide_30_5 | SCN11A | CCG | C/5 | P396L | GAGCCCGGGUUAAGUUAAUCAGGUAGAAGGA (SEQ ID NO: 681) |
| NM_014139.2_F_30bp_C-flip_guide_30_7 | SCN11A | CCG | C/7 | P396L | GACAGCCCGGGUUAAGUUAAUCAGGUAGAAG (SEQ ID NO: 682) |
| NM_014139.2_F_30bp_C-flip_guide_30_9 | SCN11A | CCG | C/9 | P396L | GCAACAGCCCGGGUUAAGUUAAUCAGGUAGA (SEQ ID NO: 683) |
| NM_014874.3_F_30bp_C-flip_guide_30_5 | MFN2 | CCG | C/5 | P76L | GGUCCCGAACCUGUUCUUCUGUGGUAACGGG (SEQ ID NO: 684) |
| NM_014874.3_F_30bp_C-flip_guide_30_7 | MFN2 | CCG | C/7 | P76L | GACGUCCCGAACCUGUUCUUCUGUGGUAACG (SEQ ID NO: 685) |
| NM_014874.3_F_30bp_C-flip_guide_30_9 | MFN2 | CCG | C/9 | P76L | GUGACGUCCCGAACCUGUUCUUCUGUGGUAA (SEQ ID NO: 686) |
| NM_015559.2_F_30bp_C-flip_guide_30_5 | SETBP1 | ACU | C/5 | T871I | GCCCACUGCCGCUGUCGCUGGGGAUCGUCUC (SEQ ID NO: 687) |
| NM_015559.2_F_30bp_C-flip_guide_30_7 | SETBP1 | ACU | C/7 | T871I | GGUCCCACUGCCGCUGUCGCUGGGGAUCGUC (SEQ ID NO: 688) |
| NM_015559.2_F_30bp_C-flip_guide_30_9 | SETBP1 | ACU | C/9 | T871I | GCUGUCCCACUGCCGCUGUCGCUGGGGAUCG (SEQ ID NO: 689) |
| NM_020630.4_F_30bp_C-flip_guide_30_5 | RET | CCG | C/5 | R620C | GUCGCCGAAGCACUUCUCCUCCUCAGGGAAG (SEQ ID NO: 690) |
| NM_020630.4_F_30bp_C-flip_guide_30_7 | RET | CCG | C/7 | R620C | GGCUCGCCGAAGCACUUCUCCUCCUCAGGGA (SEQ ID NO: 691) |
| NM_020630.4_F_30bp_C-flip_guide_30_9 | RET | CCG | C/9 | R620C | GGGGCUCGCCGAAGCACUUCUCCUCCUCAGG (SEQ ID NO: 692) |
| ApoE4 rs429358 C flip 30 | APOE | GCG | C/30 | C130R | Gccacguccuccauguccgcgcccagccggg (SEQ ID NO: 693) |
| ApoE4 rs429358 C flip 28 | APOE | GCG | C/28 | C130R | Ggcccacguccuccauguccgcgcccagccg (SEQ ID NO: 694) |
| ApoE4 rs429358 C flip 26 | APOE | GCG | C/26 | C130R | Gccgcccacguccuccauguccgcgcccagc (SEQ ID NO: 695) |

TABLE 23-continued

Guide sequences used for synthetic target editing

| Name | Targeted gene | Motif | Base flip/ position | Codon change | Spacer sequence |
|---|---|---|---|---|---|
| ApoE4 rs429358 C flip 24 | APOE | GCG | C/24 | C130R | Gggccgcccacguccucc auguccgcgccca (SEQ ID NO: 696) |
| ApoE4 rs429358 C flip 22 | APOE | GCG | C/22 | C130R | Ggcggccgcccacguccu ccauguccgcgcc (SEQ ID NO: 697) |
| ApoE4 rs429358 C flip 20 | APOE | GCG | C/20 | C130R | Gaggcggccgcccacguc cuccauguccgcg (SEQ ID NO: 698) |
| ApoE4 rs429358 C flip 18 | APOE | GCG | C/18 | C130R | Gccaggcggccgcccacg uccuccauguccg (SEQ ID NO: 699) |
| ApoE4 rs429358 C flip 16 | APOE | GCG | C/16 | C130R | Gcaccaggcggccgccca cguccuccauguc (SEQ ID NO: 700) |
| ApoE4 rs7412 C flip 30 | APOE | GCG | C/30 | C176R | Gccuucugcaggucaucg gcaucgcggagga (SEQ ID NO: 701) |
| ApoE4 rs7412 C flip 28 | APOE | GCG | C/28 | C176R | Ggcccuucugcaggucau cggcaucgcggag (SEQ ID NO: 702) |
| ApoE4 rs7412 C flip 26 | APOE | GCG | C/26 | C176R | Gaggcccuucugcagguc aucggcaucgcgg (SEQ ID NO: 703) |
| ApoE4 rs7412 C flip 24 | APOE | GCG | C/24 | C176R | Gccaggcccuucugcagg ucaucggcaucgc (SEQ ID NO: 704) |
| ApoE4 rs7412 C flip 22 | APOE | GCG | C/22 | C176R | Gugccaggcccuucugca ggucaucggcauc (SEQ ID NO: 705) |
| ApoE4 rs7412 C flip 20 | APOE | GCG | C/20 | C176R | Gacugccaggcccuucug caggucaucggca (SEQ ID NO: 706) |
| ApoE4 rs7412 C flip 18 | APOE | GCG | C/18 | C176R | Gacacugccaggcccuuc ugcaggucaucgg (SEQ ID NO: 707) |
| ApoE4 rs7412 C flip 16 | APOE | GCG | C/16 | C176R | Gguacacugccaggcccu ucugcaggucauc (SEQ ID NO: 708) |

TABLE 24

Mammalian plasmids and maps

| Plasmid | Description | Benchling link |
|---|---|---|
| pC0043 | PspCas13b crRNA backbone | benchling.com/s/seq-OH6nMmZCZn930BWqcFNa |
| pC0076 | CMV-dCas13b6-mapkNES-GS-dADAR2 E488Q | benchling.com/s/seq-BulRvsrtwP4aEJtTqYM2 |
| pC0077 | pCMV-dCas13b6-mapkNES-GS-dADAR2(E488Q/V351G/S486A/T375S/S370C/P462A/N597I/L332I/I398V) RESCUEv8 | benchling.com/s/seq-gQ13PMPLkcO6OceAfmpC |
| pC0078 | pCMV-dCas13b6-mapkNES-GS-dADAR2(E488Q/V351G/S486A/T375S/S370C/P462A/N597I/L332I/I398V/K350I/ | benchling.com/s/seq-19Ytwwh0i0vSIbyXYZ95 |

TABLE 24-continued

Mammalian plasmids and maps

| Plasmid | Description | Benchling link |
|---|---|---|
| | M383L/D619G/S582T/V440I/S495N/K418E/S661T) V16 | |
| pC0079 | pCMV-dCas13b6-mapkNES-GS-dADAR2(E488Q/V351G/S486A/T375A/S370C/P462A/N597I/L332I/I398V/K350I/M383L/D619G/S582T/V440I/S495N/K418E/S661T) V16S | benchling.com/s/seq-WX6VnavLS6JaaZ54XAOx |
| pC0080 | pCMV-dCas13b12-HIVNES-GS-dADAR2(E488Q/V351G/S486A/T375S/S370C/P462A/N597I/L332I/I398V/K350I/ | benchling.com/s/seq-GQqPCRE916KnEfHksQem |

TABLE 24-continued

| Mammalian plasmids and maps | | |
|---|---|---|
| Plasmid | Description | Benchling link |
| | M383L/D619G/S582T/V440I/ S495N/K418E/S661T) V16 | |
| pC0081 | pCMV-dCas13b12-HIVNES-GS-dADAR2(E488Q/V351G/ S486A/T375S/S370C/P462A/ N597I/L332I/I398V/K350I/ M383L/D619G/S582T/V440I/ S495N/K418E/S661T/ S375A) V16S | benchling.com/s/seq-qjbEAXZgupeRXBa8ablS |
| pC0082 | CMV-Cluciferase-polyA EF1a-G-luciferase(C82R)-polyA C to U reporter TCG motif | benchling.com/s/seq-Qjsg3Yx0r1Hs77GT58BI |
| pC0083 | CMV-Cluciferase-polyA EF1a-G-luciferase(C82R)-polyA C to U reporter GCG motif | benchling.com/s/seq-Z8zwu3LdetcuYHAFGnpe |
| pC0084 | CMV-Cluciferase-polyA EF1a-G-luciferase(C82R)-polyA C to U reporter ACG motif | benchling.com/s/seq-G2Iag6I8NBQAXqbJnou5 |
| pC0085 | CMV-Cluciferase-polyA EF1a-G-luciferase(C82R)-polyA C to U reporter CCG motif | benchling.com/s/seq-alkwhNUsFTg80TVmpquP |
| pC0086 | CMV-Cluciferase-polyA EF1a-G-luciferase(L77P)-polyA C to U reporter CCA motif | benchling.com/s/seq-1J8Fm6vtF7GS676Q7pwS |
| pC0087 | CMV-Cluciferase-polyA EF1a-G-luciferase(L77P)-polyA C to U reporter CCT motif | benchling.com/s/seq-5MMokwvxoAjq6ML2sjjZ |
| pC0088 | pCMV-ADAR2dd(E488Q/ V351G/S486A/T375S/ S370C/P462A/N597I/ L332I/I398V/K350I/ M383L/D619G/S582T/ V440I/S495N/K418E/ S661T) V16 | benchling.com/s/seq-YISAybq2YnuclVwYDy95 |
| pC0089 | pCMV-ADAR2 full length (E488Q/V351G/S486A/T375S/ S370C/P462A/N597I/L332I/ I398V/K350I/M383L/D619G/ S582T/V440I/S495N/K418E/ S661T) V16 | benchling.com/s/seq-95ZpoHj9GhQFzIu3m6cb |
| pC0090 | Beta catenin reporter M50 Super 8x (TCF/LEF binding sites) TOPFlash with Gluc/Cluc | benchling.com/s/seq-jPxZnxs3wSeKZhgTTDBu |
| pC0091 | Beta catenin reporter control M51 Super 8x (mutated TCF/LEF binding sites) FOPFlash with Gluc/Cluc | benchling.com/s/seq-130b6c9baCfw8R3lTgSR |

TABLE 25

| Yeast plasmids and maps | | |
|---|---|---|
| Plasmid | Description | Benchling link |
| pC0092 | pGAL-dCas13b6-GS-dADAR2 [RESCUE v0 Yeast] | benchling.com/s/seq-w1l2aOHR2gSe4P2aQ7VY |
| pC0093 | pGAL-dCas13b6-GS-dADAR2(V351/S486A/T375S) [RESCUE v3 Yeast] | benchling.com/s/seq-saQngvNf6i3GhSGF0H3I |
| pC0094 | pGAL-dCas13b6-GS-dADAR2(V351G/S486A/T375S/ S370C/P462A/L332I) [RESCUE v7 Yeast] | benchling.com/s/seq-GIJ7BnpV3Vd3XtKiIxdm |
| pC0095 | pGAL-dCas13b6-GS-dADAR2(V351/S486A/T375S/ S370C/P462A/N597I/L332I/ I398V/K350I/M383L/D619G/ S582T/V440I/S495N/K418/ ES661T) [RESCUE v16 Yeast] | benchling.com/s/seq-vRnAMIwozJk5r6LmOCgG |
| pC0096 | pYES3/CT pADH1-HH-Targeting-B6_DR-HDV--space-ADH1_terminator His (P196L) [Yeast target His P196L] | benchling.com/s/seq-Xs2ffVMn4FwwQ79zDDEo |
| pC0097 | pYES3/CT pADH1-HH-Golden-gate-BsmBi-BsmbI_DR--HDV-space-ADH1_terminator His (P196L) [Yeast target His P196L NT] | benchling.com/s/seq-UM9NjG7JKK0GFe9MowGo |
| pC0098 | pYES3/CT pADH1-HH-Guide-B6_DR--HDV-space-ADH1_terminator His S129P [Yeast target His S129P] | benchling.com/s/seq-EefJI5brqll3fm0B5Qc5 |
| pC0099 | pYES3/CT pADH1-HH-Golden-gate-BsmBi-BsmbI_DR--HDV-space-ADH1_terminator His Motifs S129P [Yeast target His S129P NT] | benchling.com/s/seq-bt7gOlrp8OuOoV3YJWZG |
| pC0100 | pYES3/CT pADH1-HH-Y66H-targeting-B6-DR-HDV-ADH1-term ATG-yeGFP Y66H [Yeast target GFP Y66H] | benchling.com/s/seq-HiMELqTYPT9y0nOAKEq2 |
| pC0101 | pYES3/CT pADH1-HH-Golden-gate-BsmBi-BsmbI_-B6_DR-HDV-ADH1-term ATG-yeGFP Y66H Reporter [Yeast target GFP Y66H NT] | benchling.com/s/seq-OCWlvnjeKYwSbG8GELTQ |

TABLE 26

| Guide sequences used for yeast targeting | | | | | |
|---|---|---|---|---|---|
| Name | Targeted gene | Motif | Base flip/spacer length/ position | Codon change | Spacer sequence |
| His L196P targeting | HIS | CCU | U/50/34 | L196P | Ucuuauggcaaccgcaug agccuugaacgcacucuc acuacggugaugau (SEQ ID NO: 709) |
| His S129P targeting | HIS | UCC | C/30/26 | S129P | Gcuugcaagugccucauc caaaggcgcaaau (SEQ ID NO: 710) |
| His Y66H targeting | EGFP | UCA | U/50/34 | Y66H | Aaacauugaacaccauua guuaaaguagugacuaag guuggccauggaac (SEQ ID NO: 711) |

Mammalian Cell Culture

Unless otherwise stated, mammalian cell culture experiments were performed in the HEK293FT line (American Type Culture Collection (ATCC)), grown in Dulbecco's Modified Eagle Medium containing glucose, sodium pyruvate, and GlutaMAX (Thermo Fisher Scientific), and supplemented with 1×penicillin-streptomycin (Thermo Fisher Scientific) and 10% fetal bovine serum (VWR Seradigm). Cells were maintained at confluency below 80%.

Unless otherwise noted, all transfections were performed with Lipofectamine 2000 (Thermo Fisher Scientific) in 96-well plates coated with poly-D-lysine (BD Biocoat). Cells were plated at approximately 20,000 cells/well 16 hours prior to transfection to ensure 90% confluency at the time of transfection. For each well on the plate, transfection plasmids were combined with Opti-MEM I Reduced Serum Medium (Thermo Fisher Scientific) to a total of 25 μl. Separately, 24.5 μl of Opti-MEM was combined with 0.5 μl of Lipofectamine 2000. Plasmid and Lipofectamine solutions were then combined and incubated for 5 minutes, after which they were pipetted onto cells.

RESCUE Editing in Mammalian Cells

To assess RESCUE activity in mammalian cells, Applicants transfected 150 ng of RESCUE vector, 300 ng of guide expression plasmid, and, when using a reporter (either luciferase, STAT activity, or Beta Catenin activity), 40 ng of the RNA editing reporter. After 48 hours, RNA from cells was harvested and reverse transcribed using a method previously described (33) with a gene specific reverse transcription primer. The extracted cDNA was then subjected to two rounds of PCR to add Illumina adaptors and sample barcodes using NEBNext High-Fidelity 2×PCR Master Mix (New England Biolabs). The library was then subjected to next generation sequencing on an Illumina NextSeq or MiSeq. RNA editing rates were then evaluated at all adenosines within the sequencing window.

In experiments where the luciferase reporter was targeted for RNA editing, Applicants also harvested the media with secreted luciferase prior to RNA harvest. Applicants measured luciferase activity with Cypridinia and *Gaussia* luciferase assay kits (Targeting Systems) on a plate reader (Biotek Synergy Neo2) with an injection protocol. All replicates performed are biological replicates.

In experiments where the input amount of RESCUE plasmid was varied, total plasmid amount was kept constant by replacing RESCUE expression plasmid with a filler plasmid expressing a CMV-driven mScarlet, except where noted. In the experiment where input amount of guide plasmid was varied, total plasmid amount was either kept constant ("with filler plasmid") via substitution of non-targeting guide, or not kept constant ("without filler plasmid"); in this experiment, there was no filler plasmid for the RESCUE plasmid.

Biochemical Characterization of RESCUE Mutations on ADAR2dd

To assess the kinetic activity of hADAR2 deaminase domain containing RESCUE mutations, multiple iterations were cloned into a pGAL-His6-TwinStrep-SUMO-hADAR2dd backbone containing the URA3 gene. The plasmids were transformed into BCY123 competent yeast cells. Briefly, frozen cells were thawed in 37° C. water bath for 15-30 seconds. 10 μL of cells per condition were centrifuged at 13,000 g in a microcentrifuge for 2 minutes and supernatant was removed. The prepared transformation mix for each construct contained 260 μL PEG 3350 prepared at 50% w/v, 50 μL of denatured salmon sperm (Thermo Fisher Scientific), 36 μL 1M Lithium Acetate, and 750 ng of plasmid in 14 μL of DI H2O. The yeast pellet was resuspended with the transformation mix and incubated in a 42° C. water bath for 30 minutes before centrifugation at 13,000 g for 30 seconds and subsequent supernatant removal. The pellet was then resuspended in 1 mL of DI H2O and 50 μL was taken into 1 mL of DI H2O for mixing. Subsequently, 200 μL was plated onto minimal glucose plates minus uracil for prototrophic selection.

Plates were incubated at 30° C. for 48 hr before seeding single colonies into 10 mL cultures of yeast minimal media supplemented with dextrose. This included yeast dropout supplement Y2001 (1.39 g/L), yeast nitrogen base without amino acids (6.7 g/L), adenine hemisulfate (0.022 g/L), histidine (0.076 g/L), leucine (0.38 g/L), tryptophan (0.076 g/L), and dextrose (20 g/L). Cultures were grown overnight before seeding the entire 10 mL into a 100 mL minimal media/dextrose culture. Following 8 hours of growth, each construct was seeded into two 2 L flasks containing 1 L of minimal media supplemented with 20 g of raffinose (VWR). These were grown overnight and induced with 100 mL of 30% galactose for eight hours before harvesting. Cultures were spun down in a Beckman Coulter Avanti J-E centrifuge at 6,000 r.p.m. for 20 minutes with pellets stored at −80° C.

Purification Methods

Whole-Transcriptome Sequencing to Evaluate ADAR Editing Specificity

For analyzing off-target RNA editing sites across the transcriptome, Applicants harvested total RNA from cells 48 hours post-transfection using the RNeasy Plus Miniprep kit (Qiagen). The mRNA fraction was then enriched using a NEBNext Poly(A) mRNA Magnetic Isolation Module (NEB) and this RNA was then prepared for sequencing using an NEBNext Ultra RNA Library Prep Kit for Illumina (NEB). The libraries were then sequenced on an Illumina NextSeq and loaded such that there were at least 5 million reads per sample.

RNA Editing Analysis for Targeted and Transcriptome-Wide Experiments

Analysis of the transcriptome-wide editing RNA sequencing data was performed on the FireCloud computational framework (software broadinstitute.org/firecloud/) using a custom workflow Applicants developed: portal.firecloud.org/#methods/m/ma_editing_final_workflow/rna_editing_final_workflow/1. For analysis, unless otherwise denoted, sequence files were randomly downsampled to 5 million reads. An index was generated using the RefSeq GRCh38 assembly with Gluc and Cluc sequences added, and reads were aligned and quantified using Bowtie/RSEM version 1.3.0. Alignment BAMs were then sorted and analyzed for RNA editing sites using REDitools (35, 36) with the following parameters: -t 8 -e -d -l -U [AG or TC or CT or GA]-p -u -m20 -T6-0 -W -v 1-n 0.0. Any significant edits found in untransfected or EGFP-transfected conditions were considered to be SNPs or artifacts of the transfection and filtered out from the analysis of off-targets. Off-targets were considered significant if the Fisher's exact test yielded a p-value less than 0.05 after multiple hypothesis correction by Benjamini Hochberg correction and at least 2 of 3 biological replicates identified the edit site. Overlap of edits between samples was calculated relative to the maximum possible overlap, equivalent to the fewer number of edits between the two samples. The percentage of overlapping edit sites was calculated as the number of shared edit sites divided by minimum number of edits of the two samples, multiplied by 100. An additional layer of filtering for known SNP positions was performed using the Kaviar (37) method for identifying SNPs.

Differential Gene Expression Analysis

Stat Phenotype Assay

Cells were transfected with RESCUE plasmids, guide plasmids targeting residues on STAT3 and STAT1, and a luciferase reporter for STAT3 (Qiagen Cignal STAT3 Reporter) and STAT1 signaling (Qiagen Cignal GAS Reporter) using lipofectamine 2000, as described above and incubated for 48 hours. After 48 hours, the Dual-Glo Luciferase Assay (Promega) was used to measure firefly and *renilla* luciferase activity in the cells. The firefly signal was normalized to the *renilla* signal to measure the relative activation of STAT3 and STAT1.

Beta Catenin Phenotype Assay

Cells were plated 24 hours prior to transfection in cell migration plates containing cores that prevent cell growth in the center of the well. After 24 hours, cells were transfected with RESCUE plasmids, guide plasmids targeting residues on Beta-catenin, and a luciferase reporter for Beta-catenin activation (Qiagen TCF/LEF Cignal Reporter) using lipofectamine 2000, as described above and incubated. After 24 hours, central cores were removed to allow for cell growth towards the center of the well. After another 24 hours of incubation, media was assayed for Gluc and Cluc luciferase signal. The relative ratio of Gluc to Cluc was calculated to determine the relative Beta catenin activation between conditions. On day 3 cells were incubated for 10 minutes with CellTracker Green CMFDA Dye (ThermoFisher Scientific) and then washed with media. Cells were imaged daily using fluorescence to measure cell growth. Cell growth into the central area of the well was measured using ImageJ software by calculating the total area of fluorescence in the central growth region. Images were processed using an automated macro with the following commands:

```
//ImageJ macro for calculating cellular area
run("8-bit");
run("Auto Local Threshold", "method=Bernsen radius=15 parameter_1=0 parameter_2=0 white");
setAutoThreshold("Default dark");
run("Measure");
```

REFERENCES

1. S. Shmakov et al., Discovery and Functional Characterization of Diverse Class 2 CRISPR-Cas Systems. Mol Cell 60, 385-397 (2015).
2. S. Shmakov et al., Diversity and evolution of class 2 CRISPR-Cas systems. Nat Rev Microbiol 15, 169-182 (2017).
3. A. A. Smargon et al., Cas13b Is a Type VI-B CRISPR-Associated RNA-Guided RNase Differentially Regulated by Accessory Proteins Csx27 and Csx28. Mol Cell 65, 618-630 e617 (2017).
4. O. O. Abudayyeh et al., C2c2 is a single-component programmable RNA-guided RNA-targeting CRISPR effector. Science 353, aaf5573 (2016).
5. S. Konermann et al., Transcriptome Engineering with RNA-Targeting Type VI-D CRISPR Effectors. Cell 173, 665-676 e614 (2018).
6. W. X. Yan et al., Cas13d Is a Compact RNA-Targeting Type VI CRISPR Effector Positively Modulated by a WYL-Domain-Containing Accessory Protein. Mol Cell 70, 327-339 e325 (2018).
7. A. East-Seletsky et al., Two distinct RNase activities of CRISPR-C2c2 enable guide-RNA processing and RNA detection. Nature 538, 270-273 (2016).

8. J. S. Gootenberg et al., Nucleic acid detection with CRISPR-Cas13a/C2c2. Science 356, 438-442 (2017).
9. O. O. Abudayyeh et al., RNA targeting with CRISPR-Cas13. Nature 550, 280-284 (2017).
10. A. East-Seletsky, M. R. O'Connell, D. Burstein, G. J. Knott, J. A. Doudna, RNA Targeting by Functionally Orthogonal Type VI-A CRISPR-Cas Enzymes. Mol Cell 66, 373-383 e373 (2017).
11. D. B. T. Cox et al., RNA editing with CRISPR-Cas13. Science 358, 1019-1027 (2017).
12. J. S. Gootenberg et al., Multiplexed and portable nucleic acid detection platform with Cas13, Cas12a, and Csm6. Science 360, 439-444 (2018).
13. H. Nishimasu et al., Crystal structure of Cas9 in complex with guide RNA and target DNA. Cell 156, 935-949 (2014).
14. T. Yamano et al., Crystal Structure of Cpf1 in Complex with Guide RNA and Target DNA. Cell 165, 949-962 (2016).
15. L. Holm, L. M. Laakso, Dali server update. Nucleic Acids Res 44, W351-355 (2016).
16. H. Yang, P. Gao, K. R. Rajashankar, D. J. Patel, PAM-Dependent Target DNA Recognition and Cleavage by C2c1 CRISPR-Cas Endonuclease. Cell 167, 1814-1828 e1812 (2016).
17. L. Liu et al., Two Distant Catalytic Sites Are Responsible for C2c2 RNase Activities. Cell 168, 121-134 e112 (2017).
18. L. Liu et al., The Molecular Architecture for RNA-Guided RNA Cleavage by Cas13a. Cell 170, 714-726 e710 (2017).
19. G. J. Knott et al., Guide-bound structures of an RNA-targeting A-cleaving CRISPR-Cas13a enzyme. Nat Struct Mol Biol 24, 825-833 (2017).
20. N. F. Sheppard, C. V. Glover, 3rd, R. M. Terns, M. P. Terns, The CRISPR-associated Csx1 protein of *Pyrococcus furiosus* is an adenosine-specific endoribonuclease. RNA 22, 216-224 (2016).
21. Z. Wu, H. Yang, P. Colosi, Effect of genome size on AAV vector packaging. Mol Ther 18, 80-86 (2010).
22. X. J. Lu, H. J. Bussemaker, W. K. Olson, DSSR: an integrated software tool for dissecting the spatial structure of RNA. Nucleic Acids Res 43, e142 (2015).
23. I. Fonfara, H. Richter, M. Bratovic, A. Le Rhun, E. Charpentier, The CRISPR-associated DNA-cleaving enzyme Cpf1 also processes precursor CRISPR RNA. Nature 532, 517-521 (2016).
24. D. Milburn, R. A. Laskowski, J. M. Thornton, Sequences annotated by structure: a tool to facilitate the use of structural information in sequence analysis. Protein Eng 11, 855-859 (1998).
25. I. M. Slaymaker et al., Rationally engineered Cas9 nucleases with improved specificity. Science 351, 84-88 (2016).
26. L. Gao et al., Engineered Cpf1 variants with altered PAM specificities. Nat Biotechnol 35, 789-792 (2017).

Example 14—Transformation of the Adenine Deaminase ADAR2 into a Cytosine Deaminase for Programmable RNA Editing Programmable RNA editing can enable reversible recoding of RNA information for research and disease treatment. Here, this example shows a C to U RNA editor, referred to as RNA Editing for Specific C to U Exchange (RESCUE), by directly evolving ADAR2 into a cytidine deaminase. RESCUE doubled the number of pathogenic mutations targetable by RNA editing and enables modulation of phosphosignaling-relevant residues, such as threonine and serine. Applicants applied RESCUE to drive β-catenin activation and cellular growth. Furthermore, RESCUE retained A to I editing activity, enabling multiplexed C to U and A to I editing through the use of tailored guide RNAs.

In summary, this example shows a programmable cytidine to uridine RNA editing with a directly evolved ADAR2 fused to CRISPR-Cas13 expands the RNA editing toolbox.

Figure 107A:
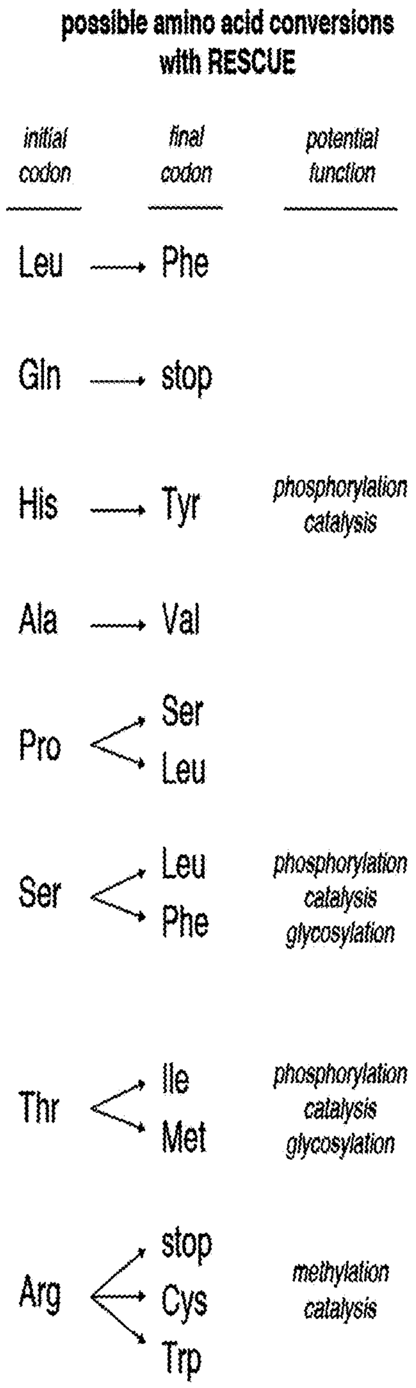
FIGS. 107A-107B Targeted RNA cytidine to uridine editing enables new base conversions.

Applicants previously developed a RNA base editing technology called REPAIR (RNA editing for programmable A to I (G) replacement), which uses the RNA targeting CRISPR effector Cas13 (1-6) to direct the catalytic domain of ADAR2 to specific RNA transcripts to achieve adenine to inosine conversion with single-base precision (7). Technologies for precise RNA editing of cytidine to uridine would greatly expand the range of addressable disease mutations as well as allow for signaling pathway modulation in cells via alteration of post-translational modification sites (FIG. 107A).

Figure 107B:
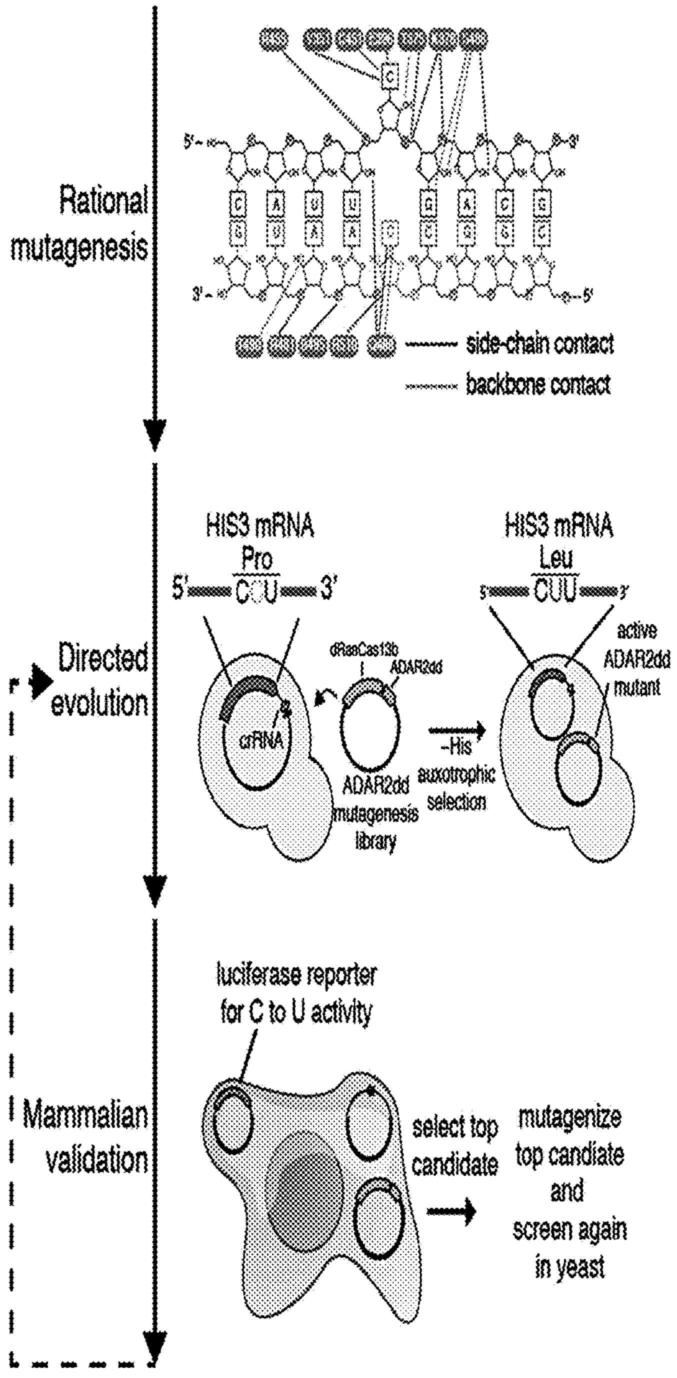
Figure 108:
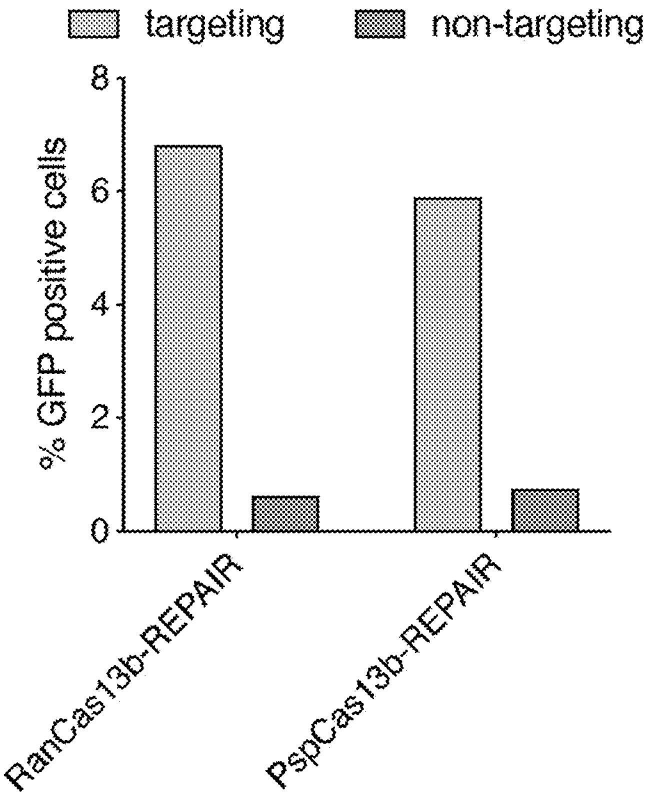
FIG. 108. Comparison of RanCas13b-REPAIR and PspCas13b-REPAIR adenosine deamination activity in yeast with targeting and non-targeting guides. A to I correction of the Y66H mutation in EGPF restores GFP fluorescence and is measured by flow cytometry. As REPAIR with the catalytically inactive Cas13b ortholog from *Riemerella anatipestifer* (dRanCas13b) was more effective than REPAIR with the catalytically inactive Cas13b ortholog from *Prevotella* sp. P5-125 (dPspCas13b), we began with a dRanCas13b-ADAR2dd fusion for development of RESCUE.
Figure 109A:
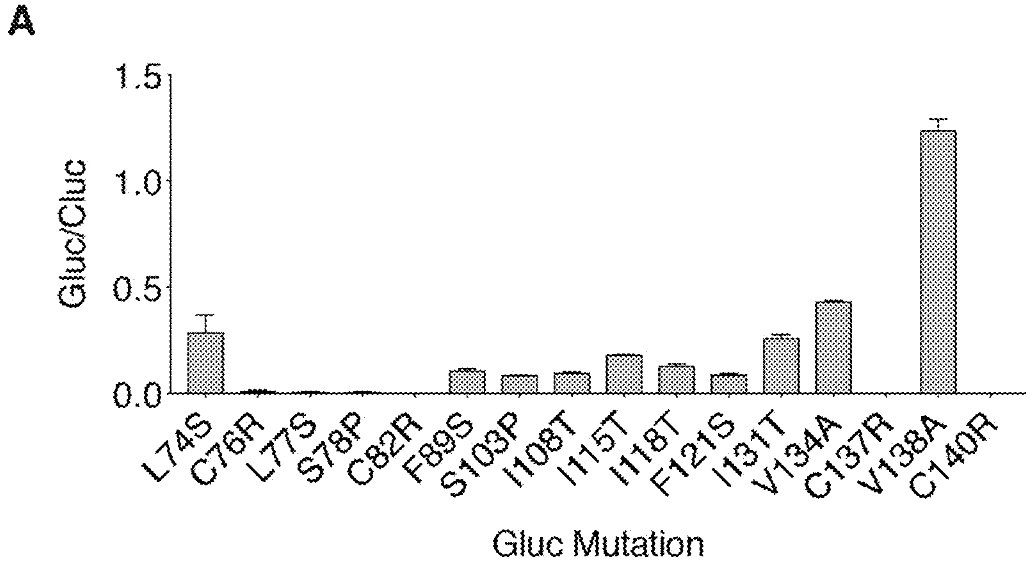
FIGS. 109A-109B Screening of inactivating Gluc mutations for generating a cytosine deamination luciferase reporter.
Figure 109B:
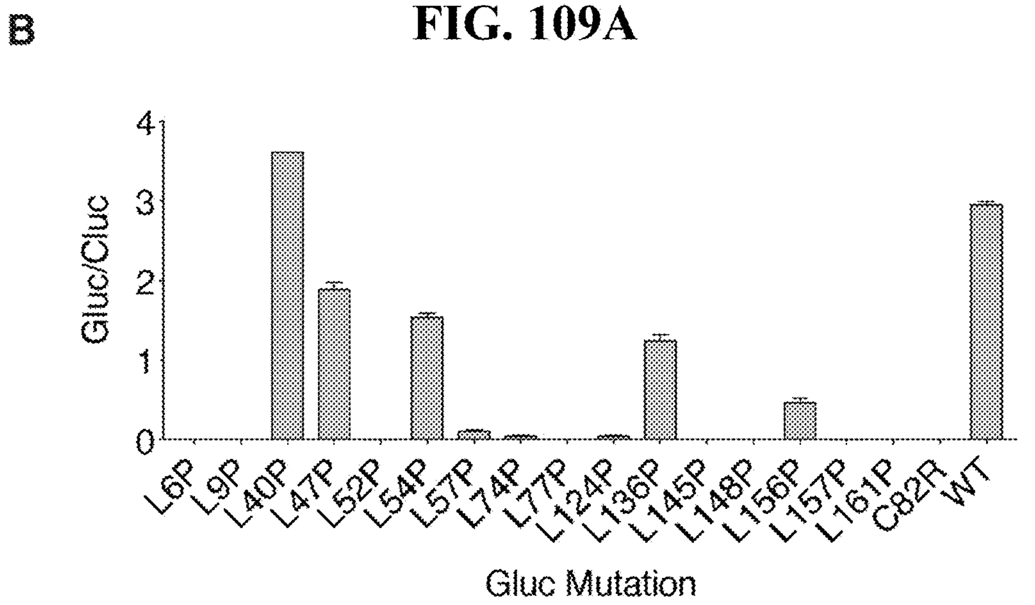

Although natural enzymes capable of catalyzing C to U conversion have been harnessed for DNA base editing (16, 17), they only operate on single stranded substrates (18), exhibit off-targets across both the genome and transcriptome (19-21), and deaminate multiple bases within a window. In this example, Applicants took a synthetic approach to evolve the adenine deaminase domain of ADAR2 (ADAR2dd), which naturally acts on double-stranded RNA substrates and preferentially deaminates a target adenine mispaired with a cytidine, into a cytidine deaminase. Applicants fused this evolved cytidine deaminase to dCas13 to develop programmable RNA Editing for Specific C to U Exchange (RESCUE) in mammalian cells (FIG. 107B), which Applicants used to edit phosphorylation signaling of STAT and β-catenin proteins and modulate cell growth. Lastly, Applicants demonstrated multiplexed A to I and C to U base conversions with RESCUE and improved the specificity of RESCUE more than 10-fold via rational mutagenesis, generating a highly specific and precise C to U RNA editing tool.

Based on the comparison of the *E. coli* cytidine deaminase and the human ADAR2dd showed remarkable structural homology between their catalytic cores (22) (FIG. 107B), Applicants selected residues of ADAR2dd contacting the RNA substrate (23) for three rounds of rational mutagenesis on an ADAR2dd fused to the catalytically inactive Cas13b ortholog from *Riemerella anatipestifer* (dRanCas13b), yielding RESCUE round 3 (RESCUEr3), with 15% editing activity (FIGS. 103A-103B, 108, 109A-109B). Applicants then began directed evolution across ADAR2dd to identify additional candidate mutations that increase the activity of RESCUE in yeast.

Figure 116:
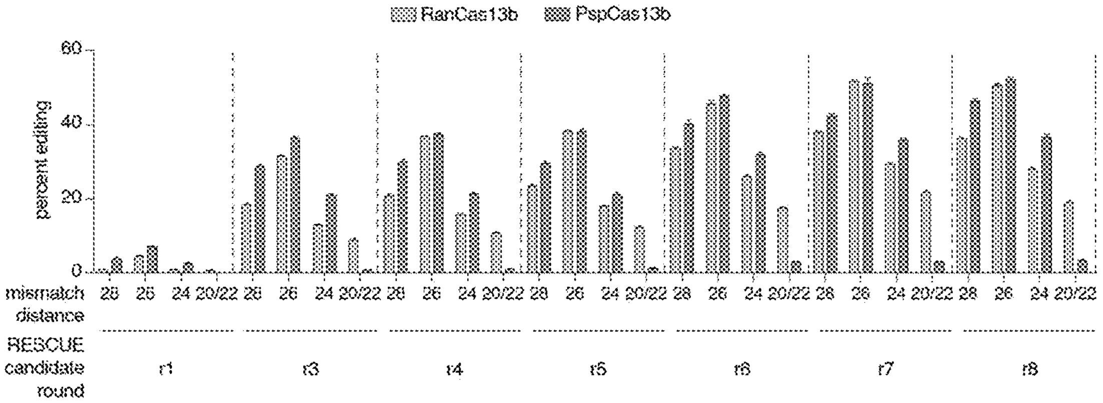
FIG. 116 Percent editing of RESCUEr1 and RESCUEr3-r8 on a UCG site in the Gluc transcript with guide RNAs of varying U mismatch positions. Candidate rounds are compared with both RanCas13b and PspCas13b. Values represent mean+/−S.E.M (n=3). 20/22 denotes 20 mismatch distance for RanCas13b and 22 mismatch distance for PspCas13b. As REPAIR uses a fusion of ADAR2dd with dPspCas13b (7), we compared our RESCUE candidate rounds with fusions of PspCas13b and RanCas13b and found them to be equivalently active.

Sixteen rounds of evolution, culminating with the final construct RESCUEr16 (hereafter referred to as just RESCUE), resulted in increased cytidine deamination activity across all motifs tested, with higher than 20% editing on 12 out of 16 possible motif combinations of the immediately neighboring 5' and 3' bases (FIG. 103C, 110, 111A-111C, 112, 113A-113E). Applicants additionally characterized guide features necessary for robust activity, finding that RESCUE was optimally active with C or U base-flips across the target base using a 30-nt guide (FIG. 103C, 114A-114C, 115). Moreover, as dRanCas13b and the catalytically inactive Cas13b ortholog from *Prevotella* sp. P5-125 (dPspCas13b) were equivalent, the final RESCUE construct used dRanCas13b (FIG. 116).

Figure 117A:
FIGS. 117A-117B View of RESCUE mutations on the crystal structure of the ADAR2 deaminase domain.
Figure 117B:
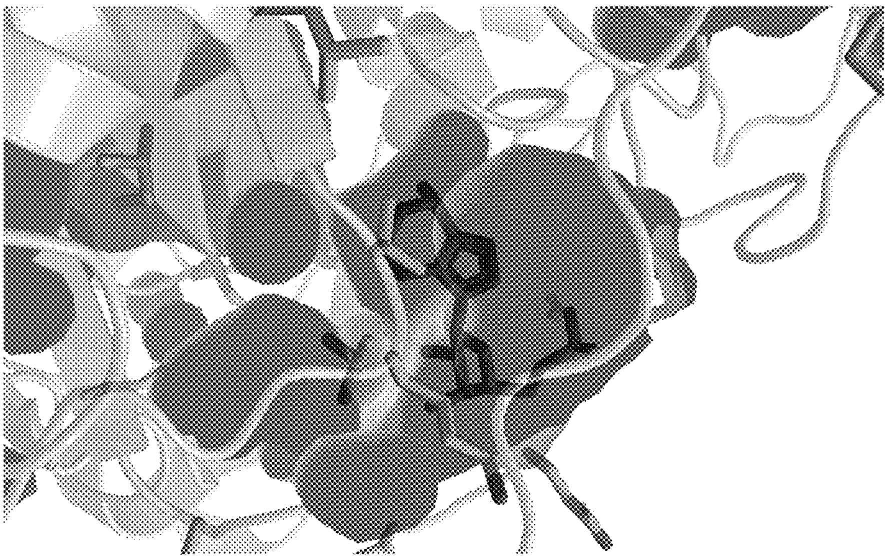
Figure 118A:
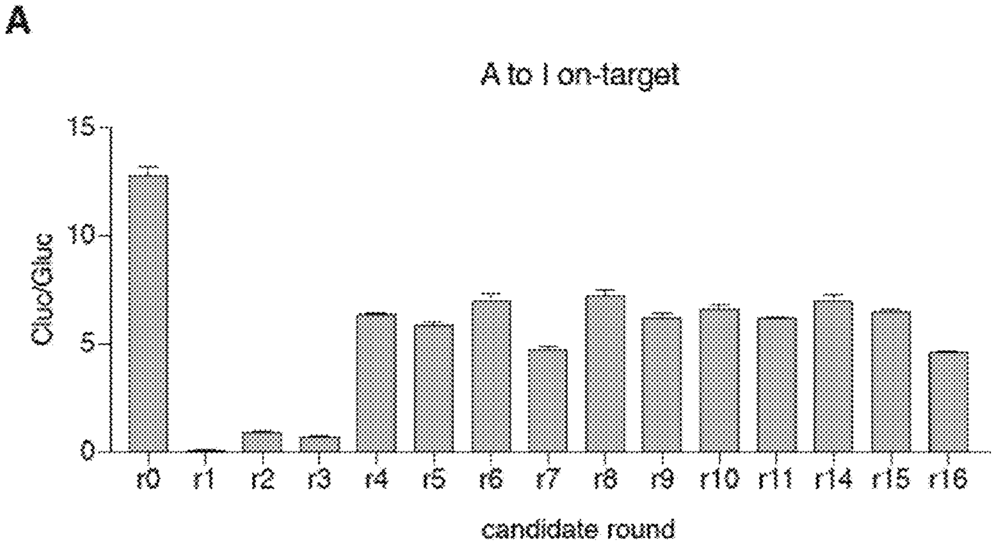
FIGS. 118A-118D Adenosine deaminase activity of RESCUEr0-r16 and RESCUEr16-S. With REPAIR, efficiency of adenosine deamination is dependent on the guide design choice of position relative to the target adenosine and base flip selection (7), as ADAR2dd prefers to deaminate in mismatch bubbles. The position of the target base within the guide:target dsRNA duplex is particularly important, as Cas13 guides can be placed anywhere without any sequence restriction and there is a small window of optimal activity for ADAR2dd (7). For RESCUE, we tested all possible guide base-flips across from the target cytosine, and found that the optimal base flips for cytidine deamination were either C or U, with optimal editing of the UCG motif with a 30-nt guide RNA with the targeting base-flip position 26 base pairs from the 5 ÅLend of the target.
Figure 118B:
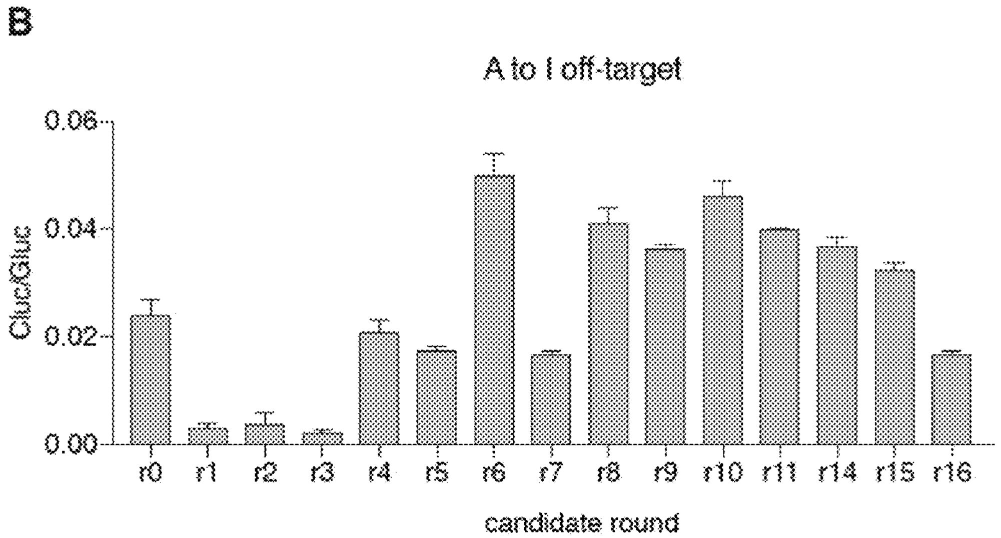
Figure 118C:
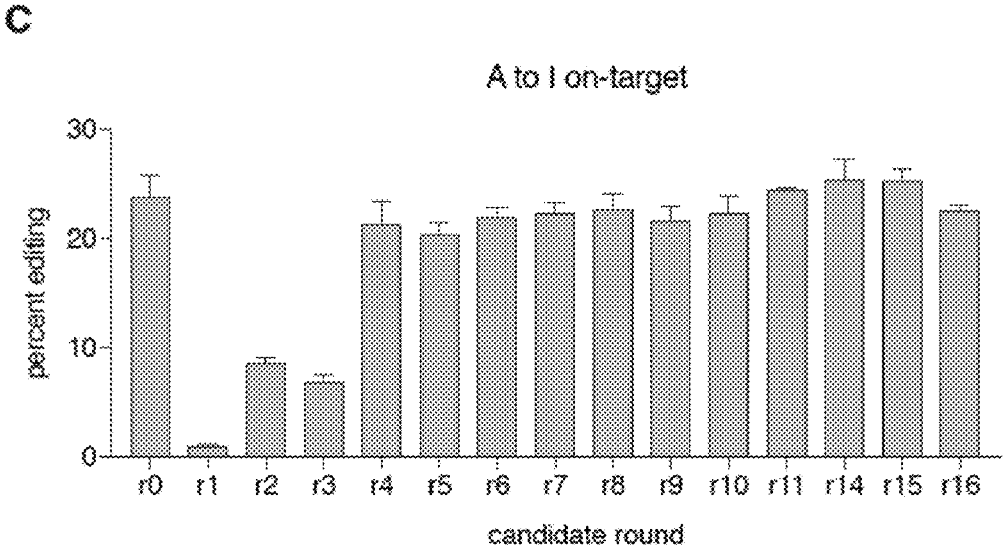
Figure 118D:
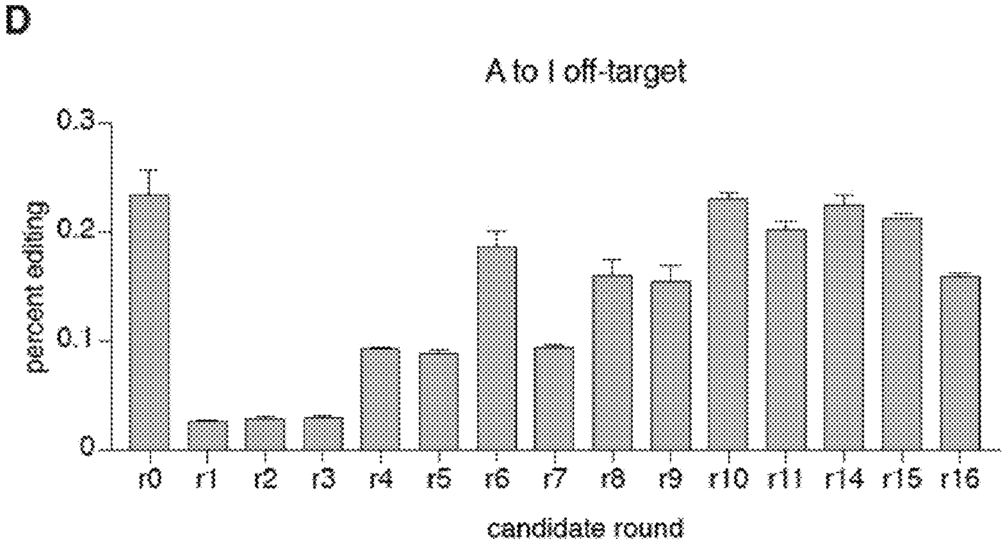
Figure 119A:
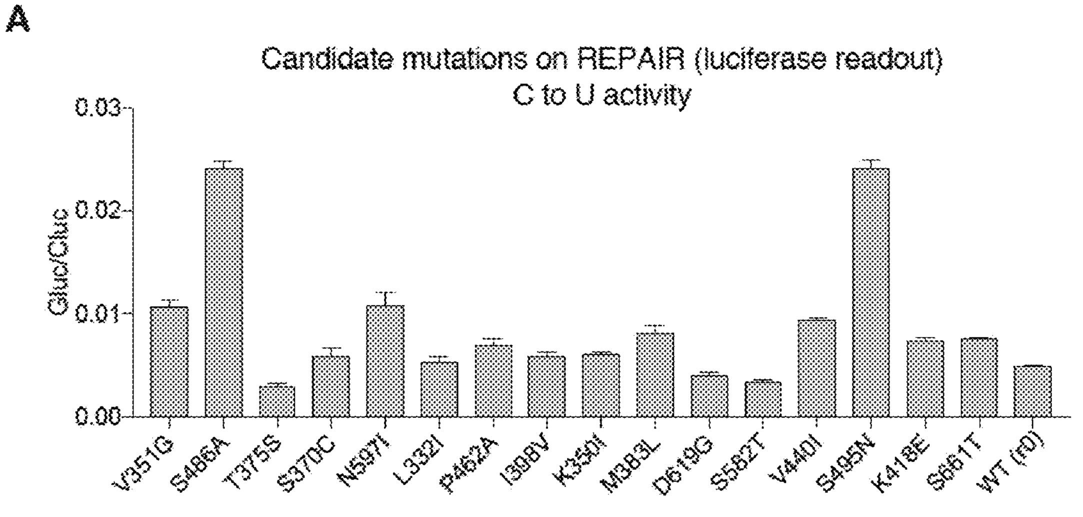
FIGS. 119A-119D Evaluation of individual RESCUE mutations added on REPAIR (RESCUEr0) or individual mutations removed from RESCUEr16.
Figure 119B:
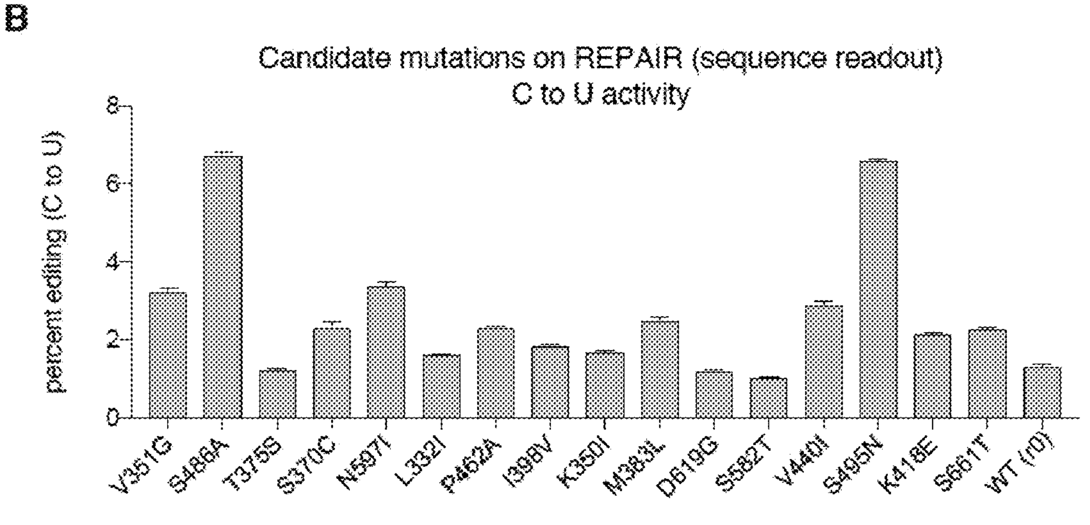
Figure 119C:
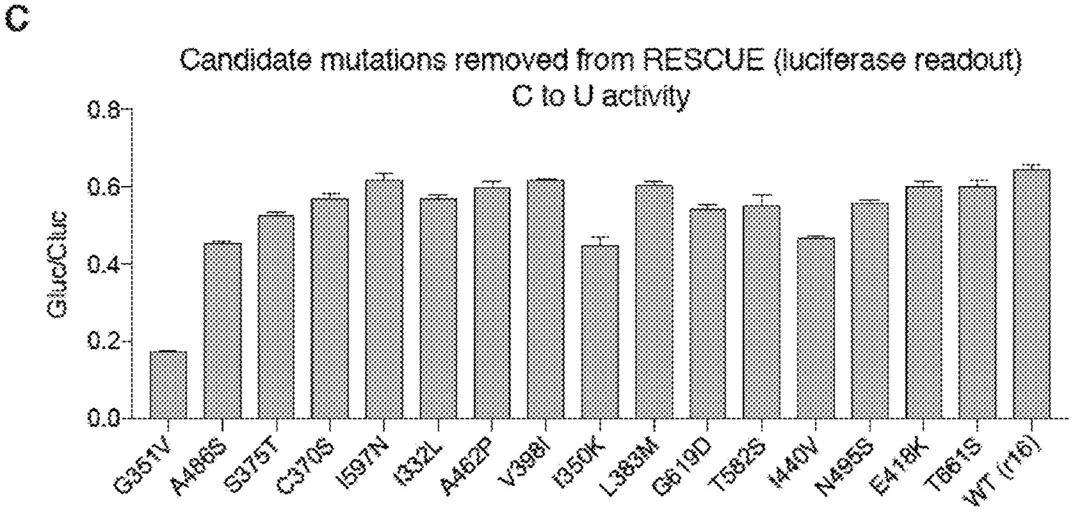
Figure 119D:
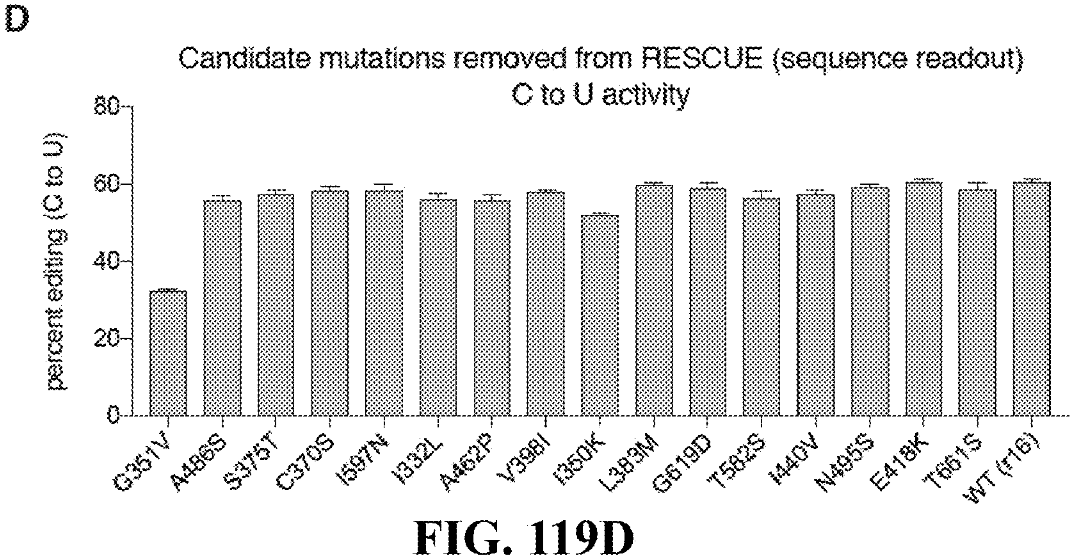
Figure 120A:
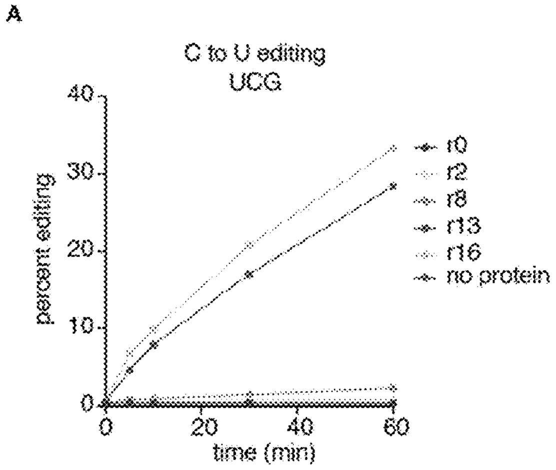
FIGS. 120A-120D Biochemical deamination activity of ADAR2 deaminase domain containing RESCUEr0, r2, r8, 13, and r16 mutations using recombinant protein.
Figure 120B:
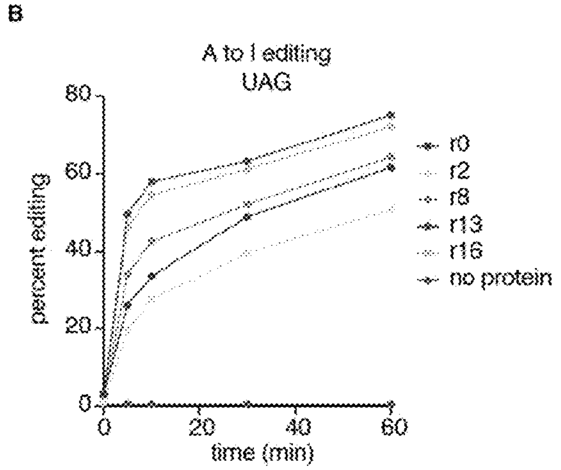
Figure 120C:
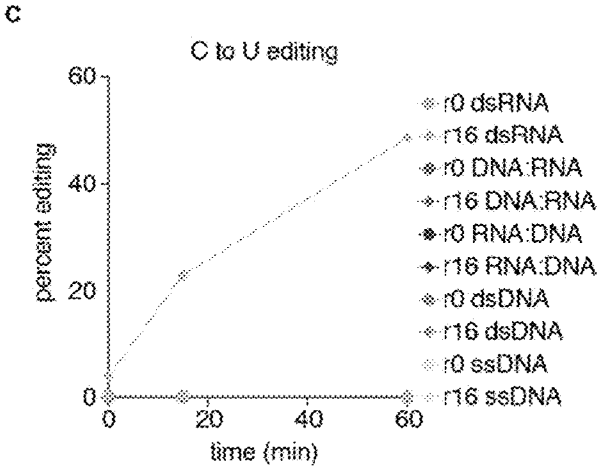
Figure 120D:
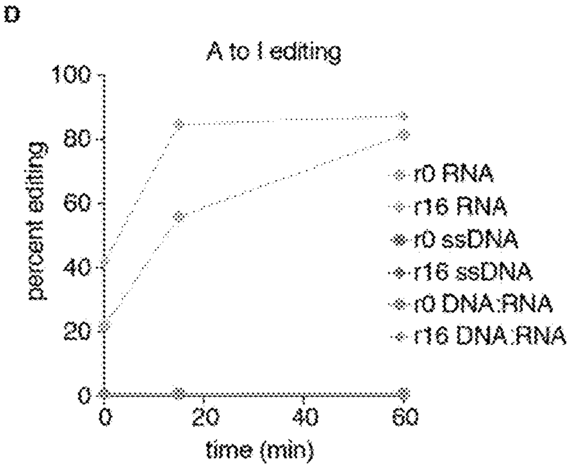

The 16 mutations in RESCUE are distributed throughout the structure of ADAR2dd (FIG. 117A), indicating both direct interactions of the evolved residues with the RNA target within the catalytic pocket as well as indirect effects (FIG. 117B). These mutations enabled fitting of either adenosine or cytidine, as RESCUE was capable of both adenosine and cytidine deamination (FIGS. 108A-108D). Applicants evaluated the role of each mutant by individually adding them to REPAIR or removing them from RESCUE. (FIGS. 119A-119D). Applicants found that mutations in the catalytic core (V351G, K350I) and contacting the RNA target (S486A, S495N) were important to RESCUE activity. Biochemical characterization of RESCUE mutations on purified ADAR2dd showed no activity on dsDNA, ssDNA, or DNA-RNA heteroduplexes, with the evolved mutations improving the kinetics of C to U editing on dsRNA substrates in vitro (FIGS. 120A-120D).

As ADAR2 has been employed in other RNA editing platforms without Cas13 (8, 9, 11, 13), Applicants assayed C to U activity in in the absence of a Cas13 fusion. Applicants introduced the RESCUE mutations into both ADAR2dd or the full-length ADAR2 protein in mammalian cells along with a guide RNA and assayed the ability of these constructs to restore luciferase activity, finding that the complete RESCUE construct, including the guide RNA direct repeat, was necessary for both adenosine and cytidine deamination activity (FIG. 103D, FIG. 121A-121D, 122A-122C, 123A-123C). To test C to U editing in alternative RNA editing systems, which rely on recruitment of MS2-ADAR2dd fusions (24) or full length ADAR2 recruitment with RNA guides (11, 24), Applicants introduced the RESCUE mutations into these constructs and found that editing efficiency was markedly reduced compared to Cas13b-based RESCUE (FIGS. 124A-124F).

Applicants next evaluated the efficiency of RESCUE on endogenous transcripts in HEK293FT cells via bulk sequencing of cell populations. Applicants tested a variety of guide designs across 24 different sites across nine genes as well as on 24 synthetic disease-relevant mutation targets from ClinVar and found editing rates up to 42% (FIG. 103E, FIGS. 125A-125C, 126A-126B, 127A-127B, 130; Table 28). Across the guides tested (Tables 29-31), Applicants found multiple guide design rules, most notably related to features of the motif (5' U or A preferred) and guide mismatch position.

Figure 104A:
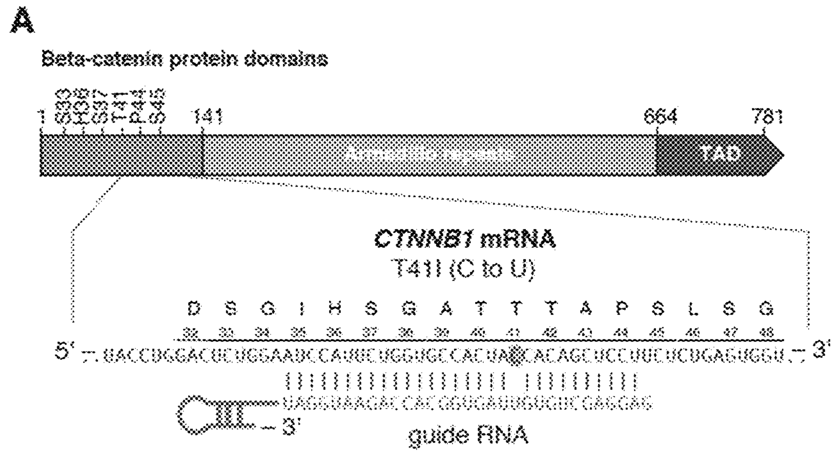
FIGS. 104A-104F Phenotypic outcomes of RESCUE on cell growth and signaling FIG. 104A. Schematic of b-catenin domains and RESCUE targeting guide (SEQ ID NO:715-717).
Figure 104B:
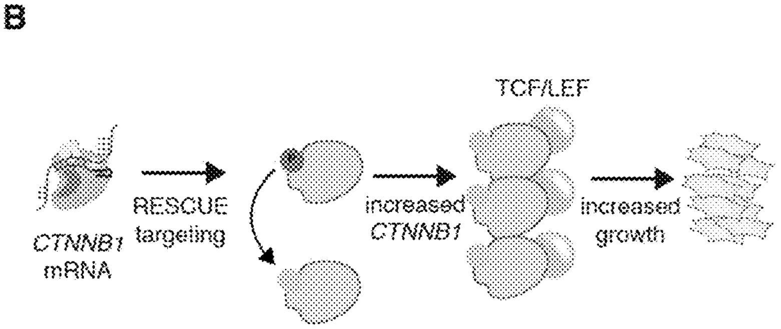
Figure 104C:
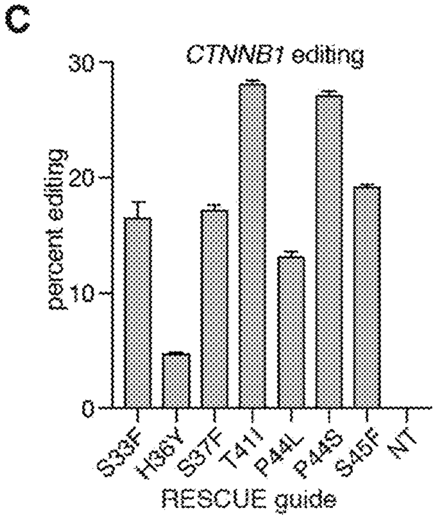
Figure 104D:
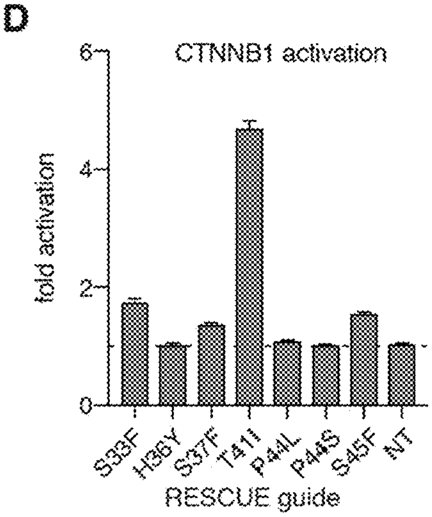
Figure 104E:
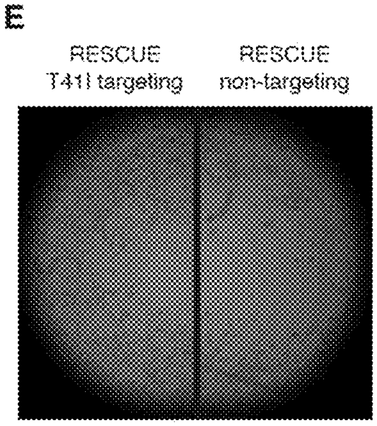
Figure 104F:
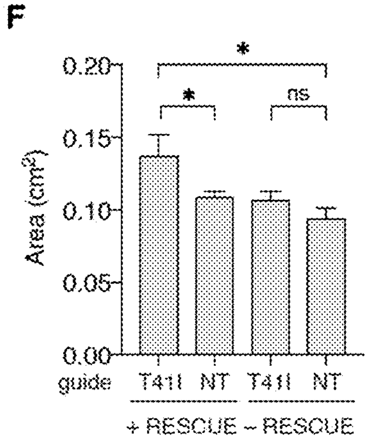

To demonstrate control of signaling pathways via RNA editing of post-translational modification sites, Applicants altered activation of the STAT and Wnt/β-catenin pathways via modulation of key phosphorylation residues (FIG. 104A, 129A-129F). Mutating phosphorylated residued on β-catenin, such as S33, S37, and T41, inhibited ubiquitination and degradation, allowing the protein to engage transcription factors like LEF and TCF1/2/3 and leading to increased cell proliferation (25) (FIG. 104B). Applicants tested a panel of guides targeting the β-catenin transcript (CTNNB1) at residues known to be phosphorylated and observed editing levels between 5% and 28% (FIG. 104C), resulting in up to 5-fold activation of Wnt/β-catenin signaling (FIG. 104D) and increased cell growth in HEK293FT (FIGS. 104E-104F) and human umbilical vein endothelial cells (HUVECs) (FIGS. 130A-130B). As therapeutic applications with RESCUE may benefit from shorter constructs for viral delivery, Applicants also evaluated RESCUE activity with C-terminal truncations of dRanCas13b and found either similar or improved deaminase activity (FIG. 131).

Figure 105A:
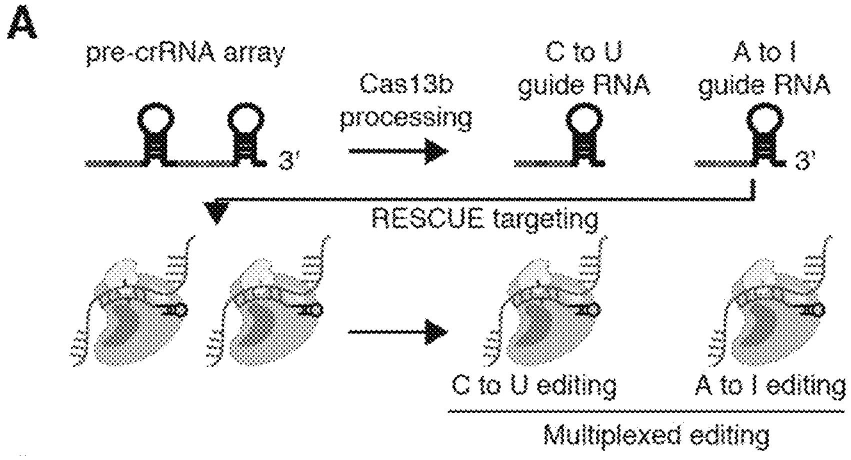
FIGS. 105A-105D RESCUE and REPAIR multiplexing and specificity enhancement via guide engineering.
Figure 105B:
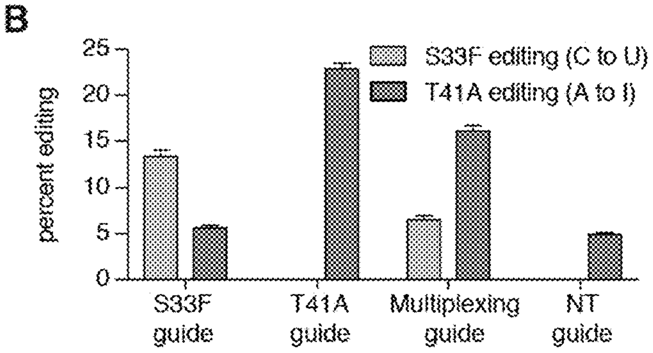
Figure 105C:
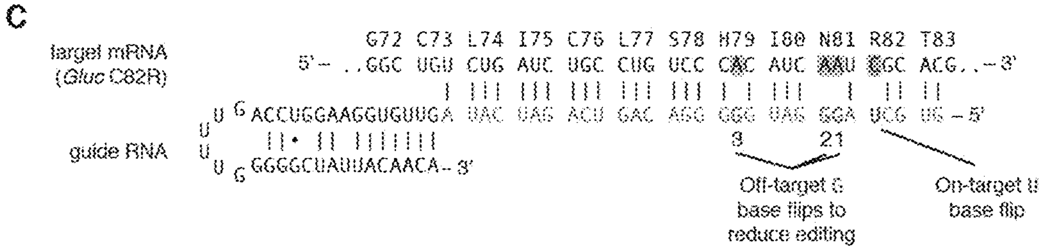
Figure 105D:
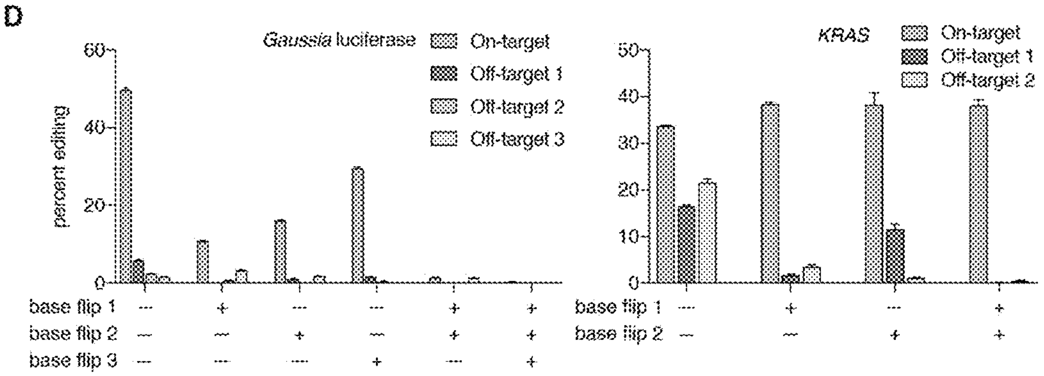

Since RESCUE retained adenosine deaminase activity (FIGS. 118A-118D), the native pre-crRNA processing activity of Cas13b (4) enabled multiplexed adenine and cytosine deamination. By delivering RESCUE along with a pre-crRNA targeting an adenine and a cytosine in the CTNNB1 transcript (FIG. 105A), Applicants found that RESCUE could edit both targeted residues S33F and T41A at rates of ~15% and 5%, respectively (FIG. 105B). However, in these experiments, as well as single-plex assays, Applicants found A to I off-targets near the targeted cytosine (FIGS. 132A-132C, 133A-133D). To eliminate these off-targets, Applicants introduced disfavorable guanine mismatches in the guide across from off-target adenosines (FIG. 105C), significantly reducing off-target editing while minimally disrupting the on-target editing (FIG. 105D).

Figure 106A:
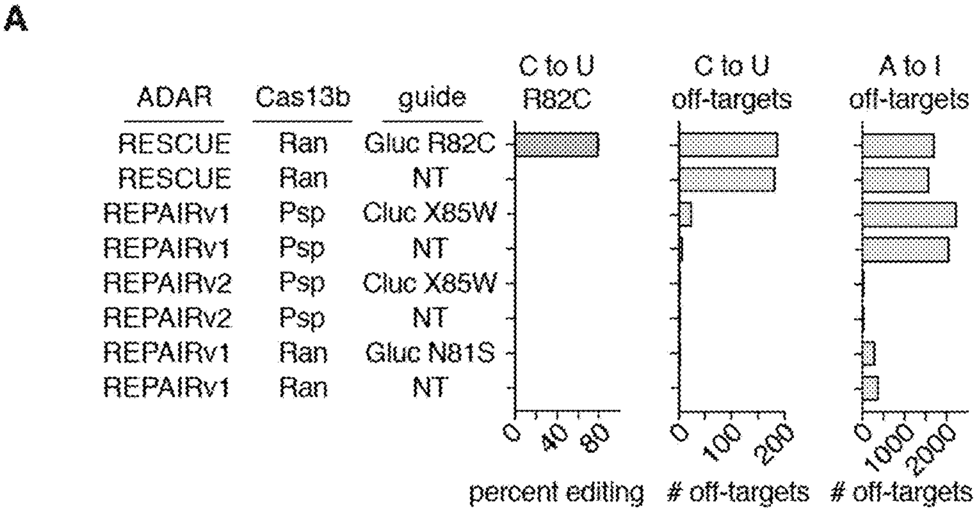
FIGS. 106A-106G Transcriptome-wide specificity of RESCUE.
Figure 106B:
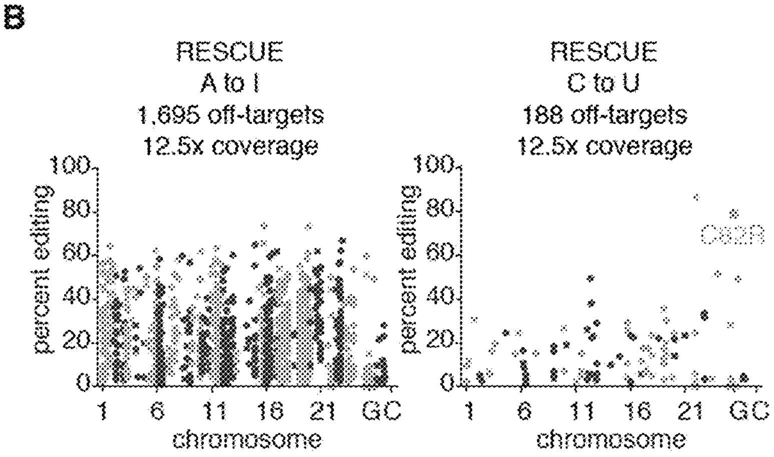
Figure 106C:
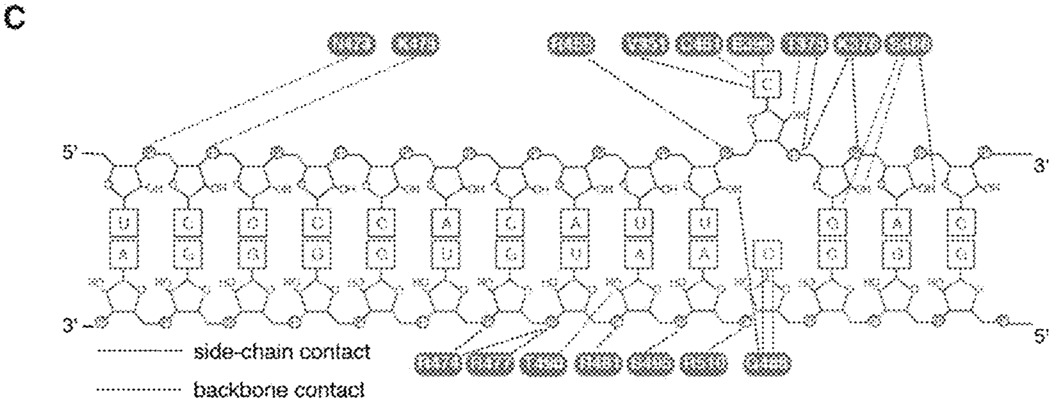
Figure 106D:
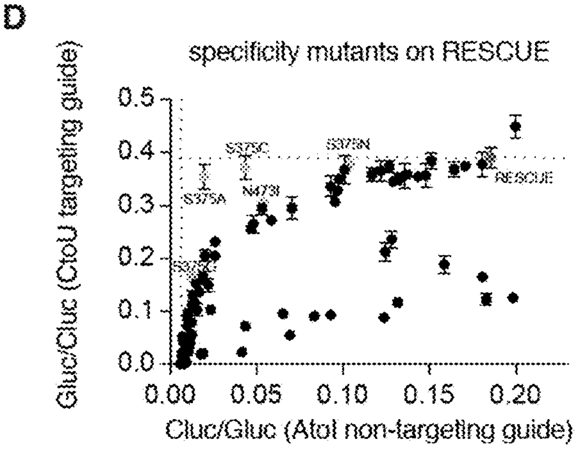
Figure 106E:
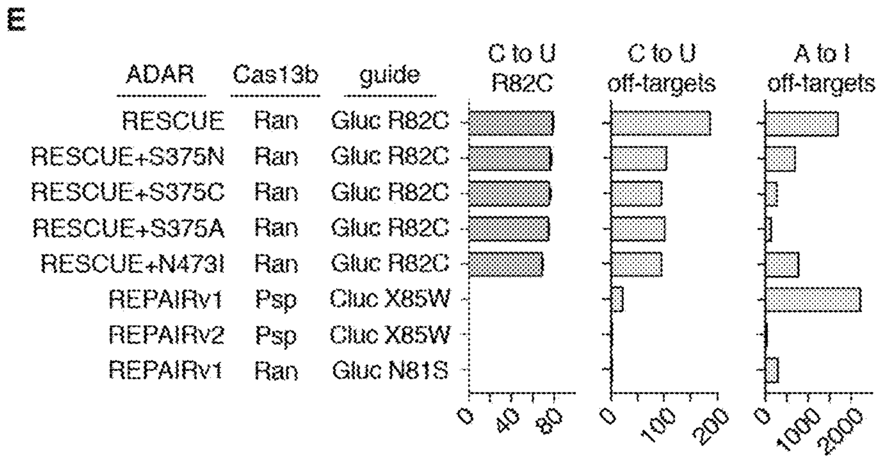
Figure 106F:
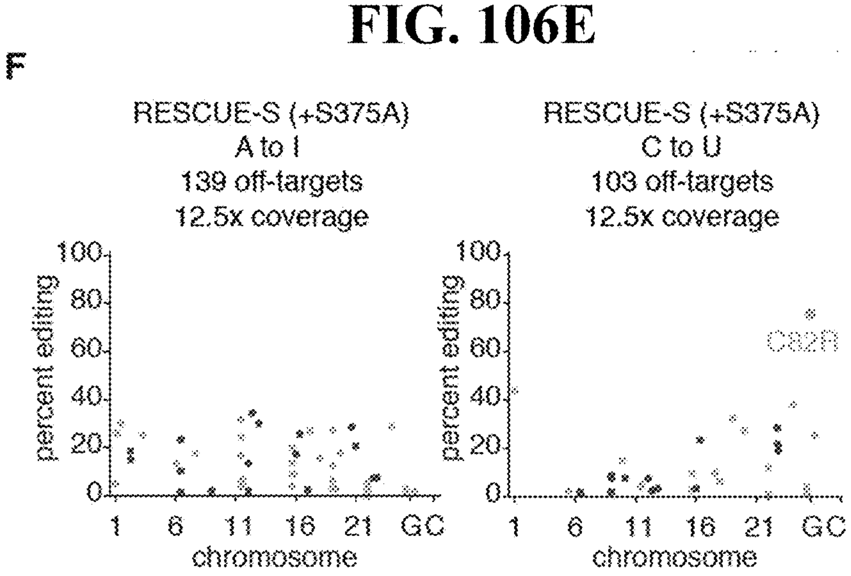
Figure 106G:
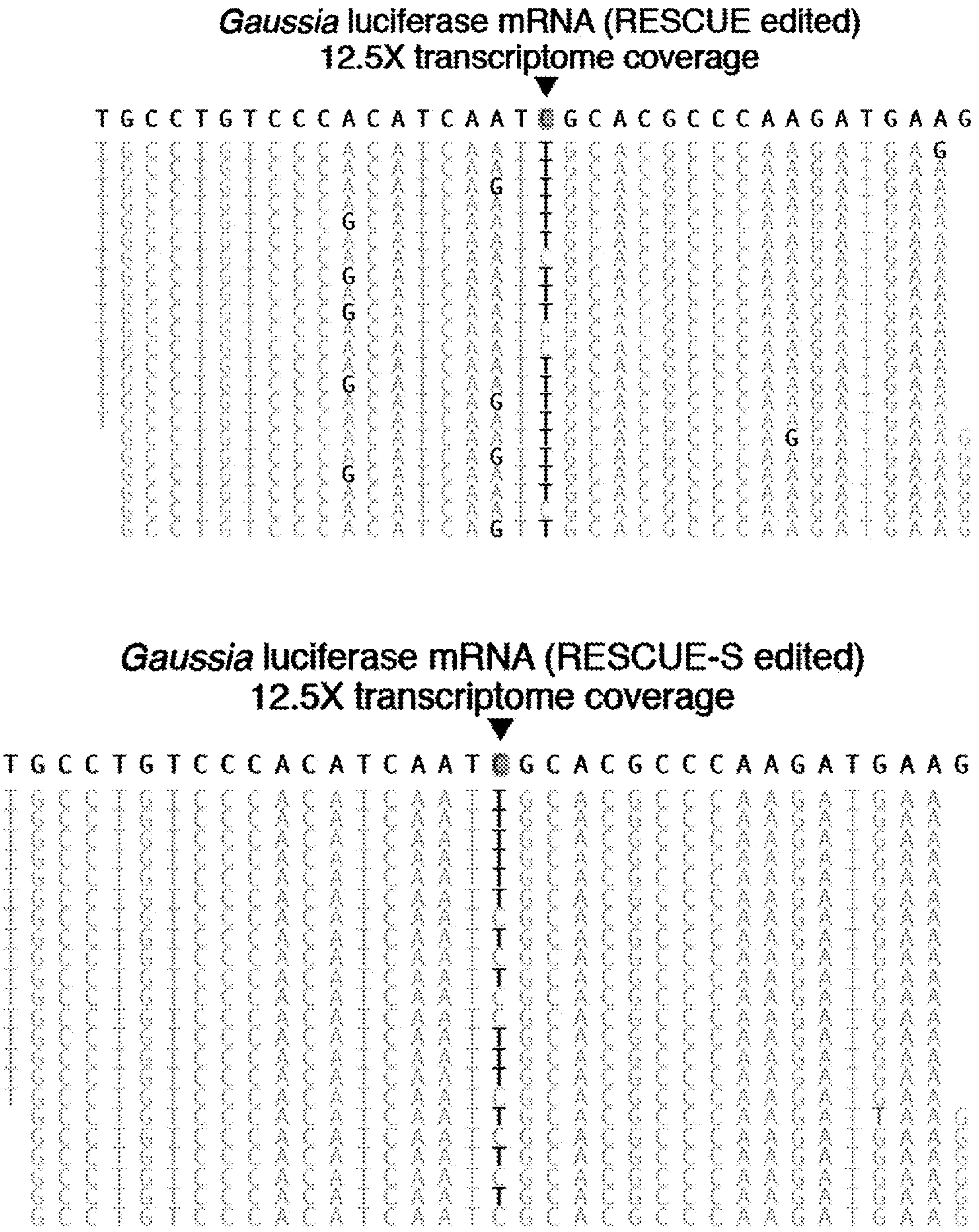

Applicants profiled off-targets with whole-transcriptome RNA-sequencing, finding that while RESCUE had ~80% C to U editing on the Gluc transcript (FIG. 106A), it had 188 C to U off-targets and 1,695 A to I off-targets, comparable to A to I off-targeting with REPAIRv1 (7)(FIGS. 108A, 108B). To improve the specificity of RESCUE Applicants performed rational mutagenesis of ADAR2dd at residues interacting with the RNA target (FIG. 106C), resulting in multiple RESCUE mutants with reduced A to I off-target activity and high C to U on-target deamination activity, as measured by a luciferase reporter (FIG. 106D) and RNA sequencing (FIGS. 106E-106G). The top specificity mutant, S375A on RESCUE (hereafter referred to as RESCUE-S), maintained ~76% on-target C to U editing (FIG. 106E), but only had 103 C to U off-targets and 139 A to I off-targets, an approximate 10-fold reduction in the number of adenine deamination off-targets (FIGS. 106E-106G), with diminished missense mutations and differentially-regulated transcripts (FIGS. 134A-134F, 135A-135C, 136A-136B, 137A-137D). Applicants also found that RESCUE-S retained similar C to U activity as RESCUE at many endogenous sites, even exceeding it at some sites (FIGS. 138A-138C, 139A-139C, 140A) with higher specificity within the local guide window (FIG. 138C, 140B-140E).

RESCUE was a programmable base editing tool capable of precise cytidine to uridine conversion in RNA. Using directed evolution, Applicants demonstrated that adenosine deaminases can be relaxed to accept other bases, resulting in a novel cytidine deamination mechanism that can edit dsRNA. While in the present study Applicants took advantage of the RNA-guided targeting mechanism of Cas13, other RNA targeting mechanisms (8-15, 24) can similarly be combined with evolved ADAR2dd mutants to achieve precise cytidine deamination on RNA transcripts. The larger targetable amino acid codon space of RESCUE's cytidine deamination activity enabled modulation of more post-translational modifications, such as phosphorylation, glycosylation, and methylation, as well as expanded targeting of common catalytic residues (FIGS. 107 and 141). Moreover, cytidine deaminase-mediated RNA editing allowed for additional targeting of disease-associated mutations and generation of protective alleles, such as ApoE2. Overall, RESCUE extended the RNA targeting toolkit with new base editing functionality, allowing for expanded modeling and potential treatment of genetic diseases.

REFERENCES

1. O. O. Abudayyeh et al., C2c2 is a single-component programmable RNA-guided RNA-targeting CRISPR effector. Science 353, aaf5573 (2016).
2. C. Cassidy-Amstutz et al., Identification of a Minimal Peptide Tag for in Vivo and in Vitro Loading of Encapsulin. Biochemistry 55, 3461-3468 (2016).
3. S. Shmakov et al., Discovery and Functional Characterization of Diverse Class 2 CRISPR-Cas Systems. Mol Cell 60, 385-397 (2015).
4. A. A. Smargon et al., Cas13b Is a Type VI-B CRISPR-Associated RNA-Guided RNase Differentially Regulated by Accessory Proteins Csx27 and Csx28. Mol Cell 65, 618-630 e617 (2017).
5. A. East-Seletsky et al., Two distinct RNase activities of CRISPR-C2c2 enable guide-RNA processing and RNA detection. Nature 538, 270-273 (2016).
6. O. O. Abudayyeh et al., RNA targeting with CRISPR-Cas13. Nature 550, 280-284 (2017).
7. D. B. T. Cox et al., RNA editing with CRISPR-Cas13. Science 358, 1019-1027 (2017).
8. T. Merkle et al., Precise RNA editing by recruiting endogenous ADARs with antisense oligonucleotides. Nat Biotechnol 37, 133-138 (2019).
9. P. Vogel et al., Efficient and precise editing of endogenous transcripts with SNAP-tagged ADARs. Nat Methods 15, 535-538 (2018).
10. M. Fukuda et al., Construction of a guide-RNA for site-directed RNA mutagenesis utilizing intracellular A-to-I RNA editing. Sci Rep 7, 41478 (2017).
11. J. Wettengel, P. Reautschnig, S. Geisler, P. J. Kahle, T. Stafforst, Harnessing human ADAR2 for RNA repair—Recoding a PINK1 mutation rescues mitophagy. Nucleic Acids Res 45, 2797-2808 (2017).
12. M. F. Montiel-Gonzalez, I. C. Vallecillo-Viejo, J. J. Rosenthal, An efficient system for selectively altering genetic information within mRNAs. Nucleic Acids Res 44, e157 (2016).
13. P. Vogel, M. F. Schneider, J. Wettengel, T. Stafforst, Improving site-directed RNA editing in vitro and in cell culture by chemical modification of the guideRNA. Angew Chem Int Ed Engl 53, 6267-6271 (2014).
14. M. F. Montiel-Gonzalez, I. Vallecillo-Viejo, G. A. Yudowski, J. J. Rosenthal, Correction of mutations within the cystic fibrosis transmembrane conductance regulator by site-directed RNA editing. Proc Natl Acad Sci USA 110, 18285-18290 (2013).
15. H. A. Rees, D. R. Liu, Base editing: precision chemistry on the genome and transcriptome of living cells. Nat Rev Genet 19, 770-788 (2018).
16. A. C. Komor, Y. B. Kim, M. S. Packer, J. A. Zuris, D. R. Liu, Programmable editing of a target base in genomic DNA without double-stranded DNA cleavage. Nature 533, 420-424 (2016).
17. K. Nishida et al., Targeted nucleotide editing using hybrid prokaryotic and vertebrate adaptive immune systems. Science 353, (2016).
18. J. D. Salter, R. P. Bennett, H. C. Smith, The APOBEC Protein Family: United by Structure, Divergent in Function. Trends Biochem Sci 41, 578-594 (2016).
19. S. Jin et al., Cytosine, but not adenine, base editors induce genome-wide off-target mutations in rice. Science, (2019).
20. E. Zuo et al., Cytosine base editor generates substantial off-target single-nucleotide variants in mouse embryos. Science, (2019).

21. J. Grunewald et al., Transcriptome-wide off-target RNA editing induced by CRISPR-guided DNA base editors. Nature, (2019).

22. M. R. Macbeth et al., Inositol hexakisphosphate is bound in the ADAR2 core and required for RNA editing. Science 309, 1534-1539 (2005).

23. M. M. Matthews et al., Structures of human ADAR2 bound to dsRNA reveal base-flipping mechanism and basis for site selectivity. Nature structural & molecular biology 23, 426-433 (2016).

24. D. Katrekar et al., In vivo RNA editing of point mutations via RNA-guided adenosine deaminases. Nat Methods 16, 239-242 (2019).

25. B. T. MacDonald, K. Tamai, X. He, Wnt/beta-catenin signaling: components, mechanisms, and diseases. Dev Cell 17, 9-26 (2009).

26. M. K. Chee, S. B. Haase, New and Redesigned pRS Plasmid Shuttle Vectors for Genetic Manipulation of *Saccharomyces cerevisiae*. G3 (Bethesda) 2, 515-526 (2012).

27. M. F. Laughery et al., New vectors for simple and streamlined CRISPR-Cas9 genome editing in *Saccharomyces cerevisiae*. Yeast 32, 711-720 (2015).

28. M. R. Macbeth, B. L. Bass, Large-scale overexpression and purification of ADARs from *Saccharomyces cerevisiae* for biophysical and biochemical studies. Methods Enzymol 424, 319-310 (2007).

29. H. Ng, N. Dean, Dramatic Improvement of CRISPR/Cas9 Editing in *Candida albicans* by Increased Single Guide RNA Expression. mSphere 2, (2017).

30. R. Heim, D. C. Prasher, R. Y. Tsien, Wavelength mutations and posttranslational autoxidation of green fluorescent protein. Proc Natl Acad Sci USA 91, 12501-12504 (1994).

31. Y. Wang, P. A. Beal, Probing RNA recognition by human ADAR2 using a high-throughput mutagenesis method. Nucleic Acids Res 44, 9872-9880 (2016).

32. R. D. Gietz, R. H. Schiestl, Large-scale high-efficiency yeast transformation using the LiAc/SS carrier DNA/PEG method. Nat Protoc 2, 38-41 (2007).

33. M. T. Veeman, D. C. Slusarski, A. Kaykas, S. H. Louie, R. T. Moon, Zebrafish prickle, a modulator of noncanonical Wnt/Fz signaling, regulates gastrulation movements. Curr Biol 13, 680-685 (2003).

Materials and Methods

Design and Cloning of Yeast Constructs

For expression of the dRanCas13b-hADAR2dd construct in yeast, the fusion protein was cloned downstream of a pGAL promoter in a pRSII426 backbone (26), by modifying pML104 (Addgene #67638) (27). To improve expression, a GS linker was cloned between the fusion proteins, and ADAR2dd was codon optimized for yeast (28). Additional codon mutations, corresponding to rounds of RESCUE, were introduced via Gibson Cloning.

Targeting plasmids for testing activity in yeast were engineered for both fluorescent screens (GFP) and auxotrophic selection screens (His). All targeting plasmids were cloned into the pYES3/CT backbone (Thermo Scientific). All plasmids contained a RanCas13b guide cassette for RESCUE, with expression driven by the ADH1 promoter, and spacer and DR sequences flanked by HH and HDV ribozymes (29). A construct with the spacer replaced by a golden gate site was cloned to facilitate modular guide cloning.

To generate a GFP indicator of C to U RNA editing activity, the Y66H green-to-blue mutation (30) was introduced into a yeast codon optimized EGFP (yeGFP) (31) driven by the TEF promoter. Successful C to U RNA editing restores the green fluorescence of this construct. His reporters for C to U editing were generated by testing conserved residues in HIS3 for loss of activity when mutated to residues that could be rescued by RNA editing (FIG. 128). Mutations that created inactive HIS3 were cloned into a HIS3 gene, under its native HIS3 promoter, in the pYES3/CT backbone.

All yeast plasmids are listed in Table 33, and all targeting guides used in yeast experiments are listed in Table 34.

RESCUE Directed Evolution

Figure 103A:
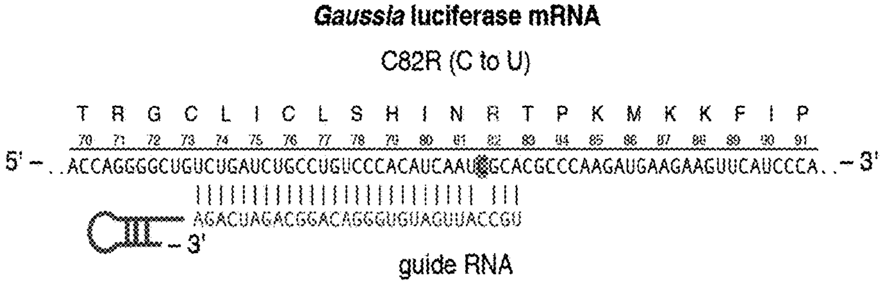
FIGS. 103A-103E Evolution of an ADAR2 deaminase domain for cytidine deamination in reporter and endogenous transcripts.
Figure 103B:
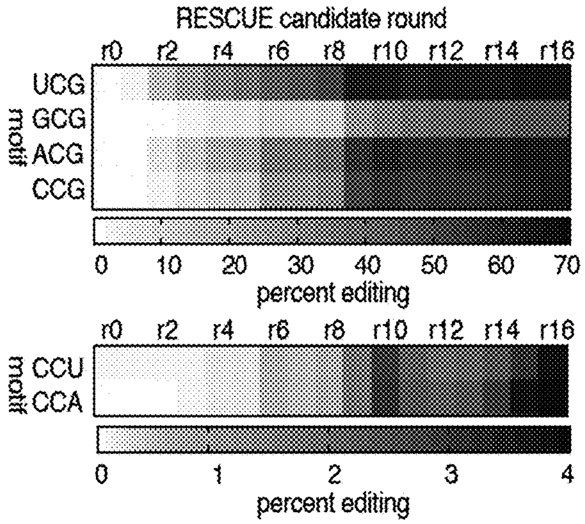
Figure 103C:
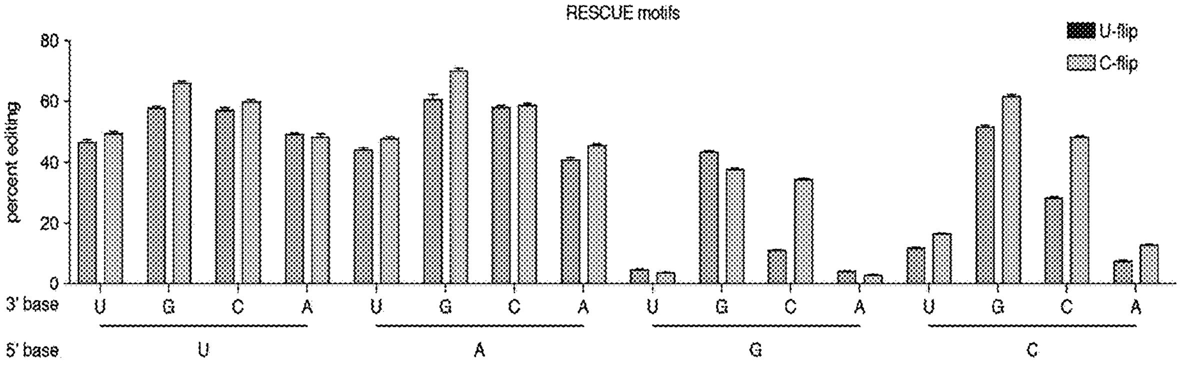
Figure 103D:
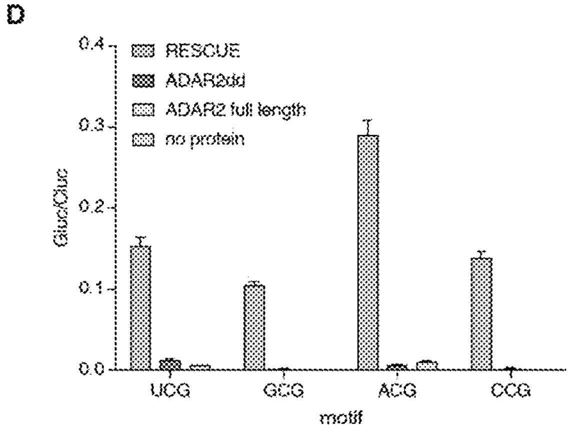
Figure 103E:
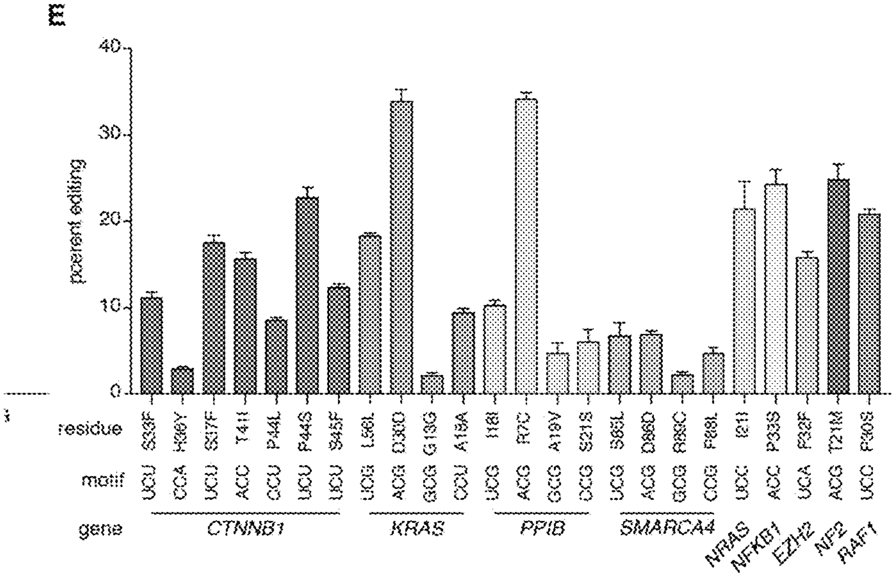
Figure 110:
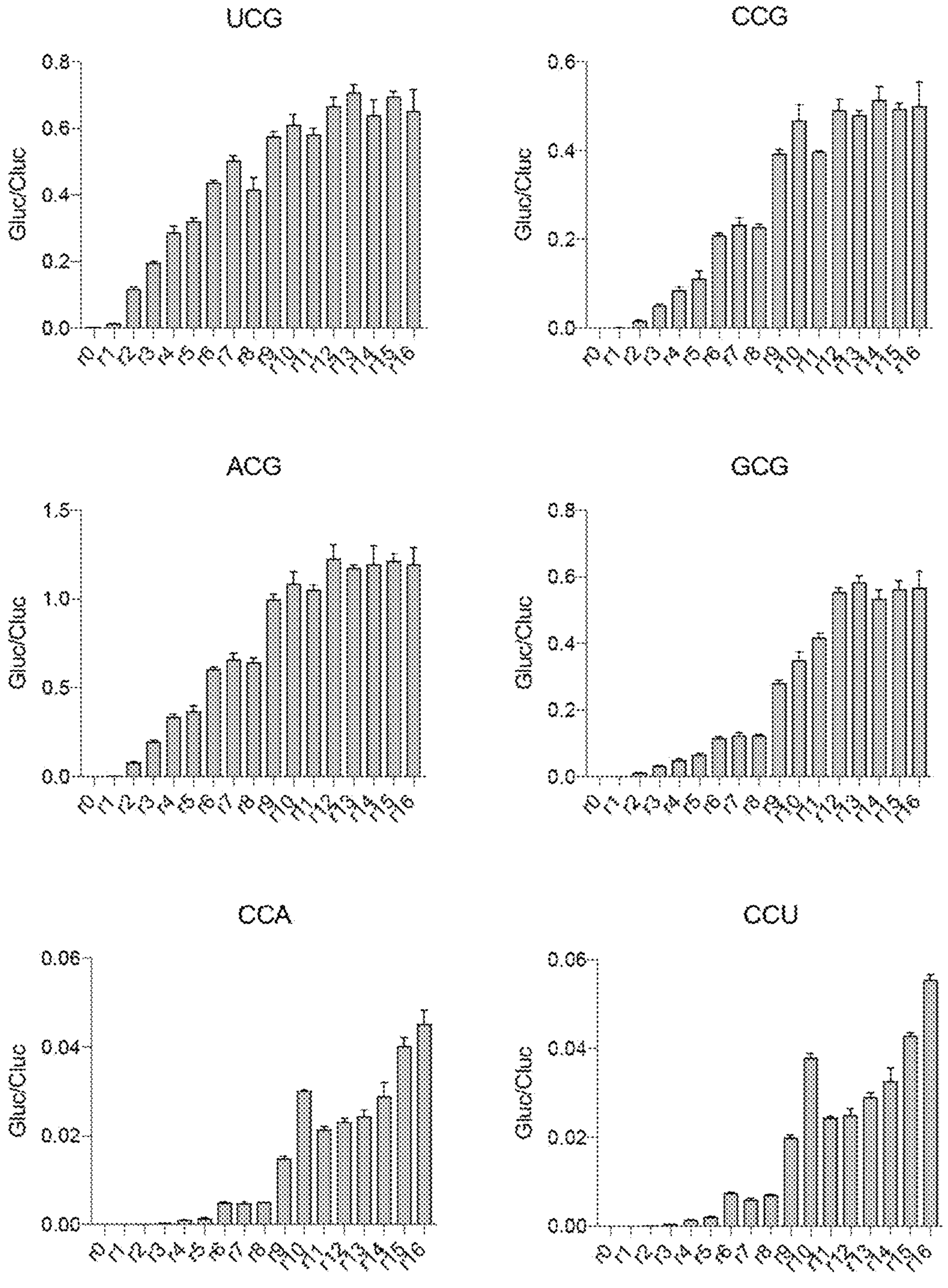
FIG. 110. Cytidine deamination activity of RESCUEr0-r16 on UCG, CCG, ACG, GCG, CCA, and CCU sites in Gluc. Values represent mean+/−S.E.M (n=3).
Figure 111A:
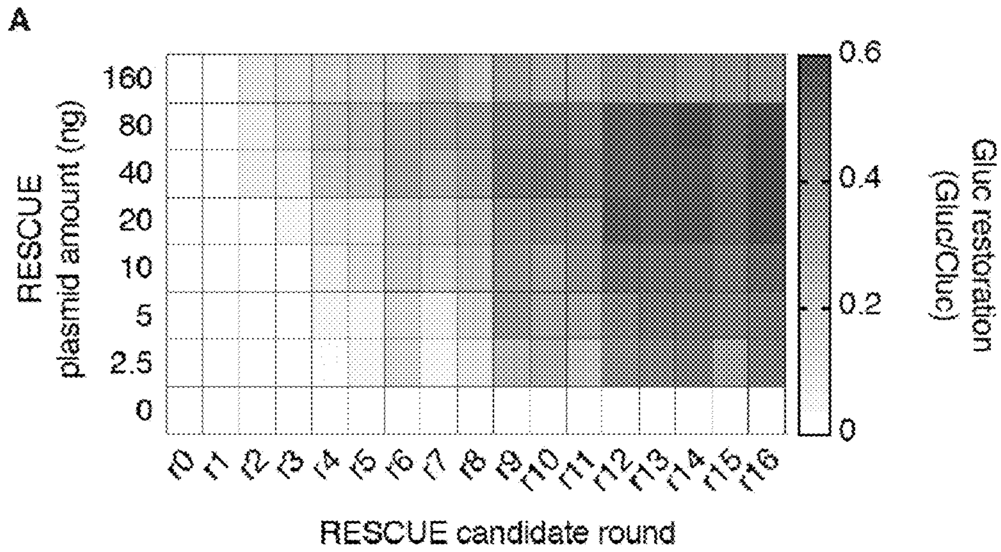
FIGS. 111A-111C Cytidine deamination activity of varying amounts of RESCUEr0-r16.
Figure 111B:
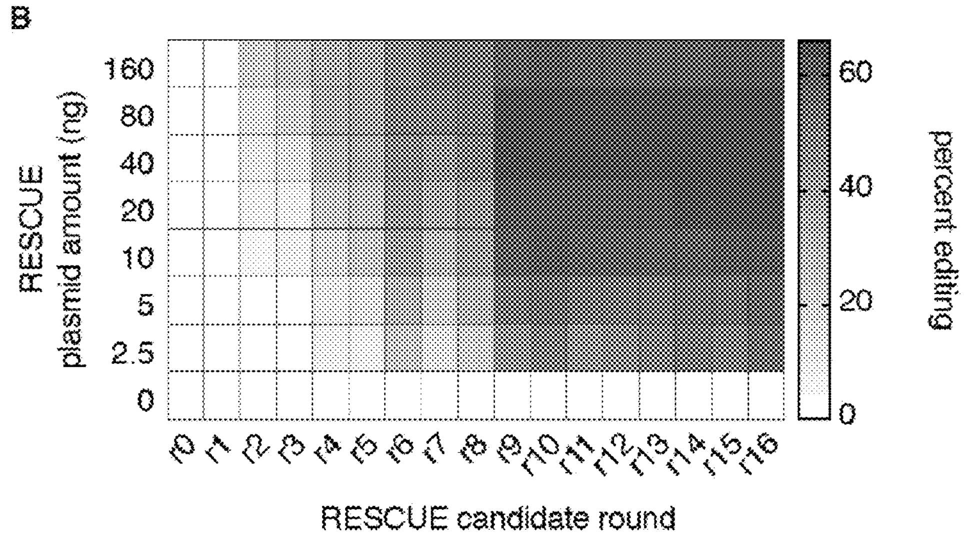
Figure 111C:
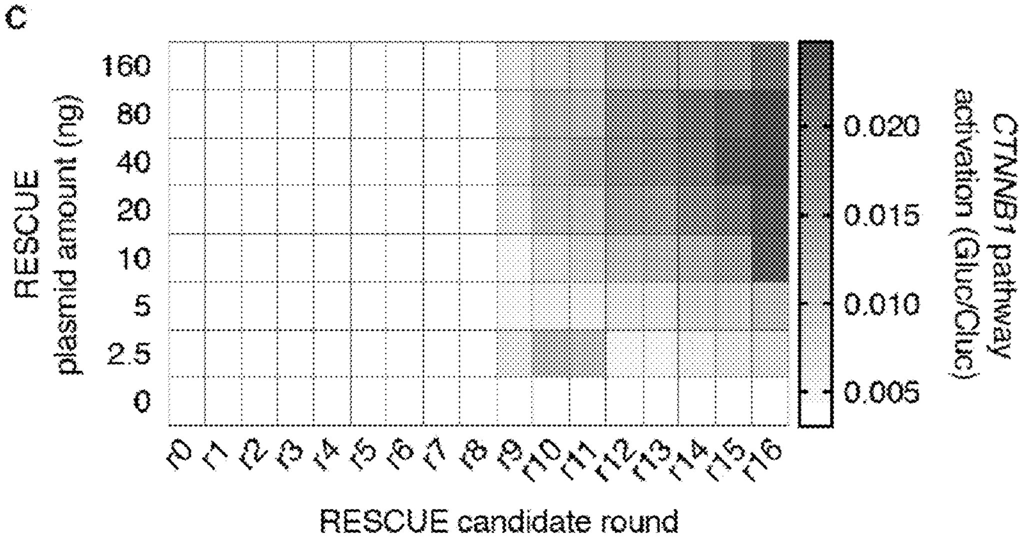
Figure 112:
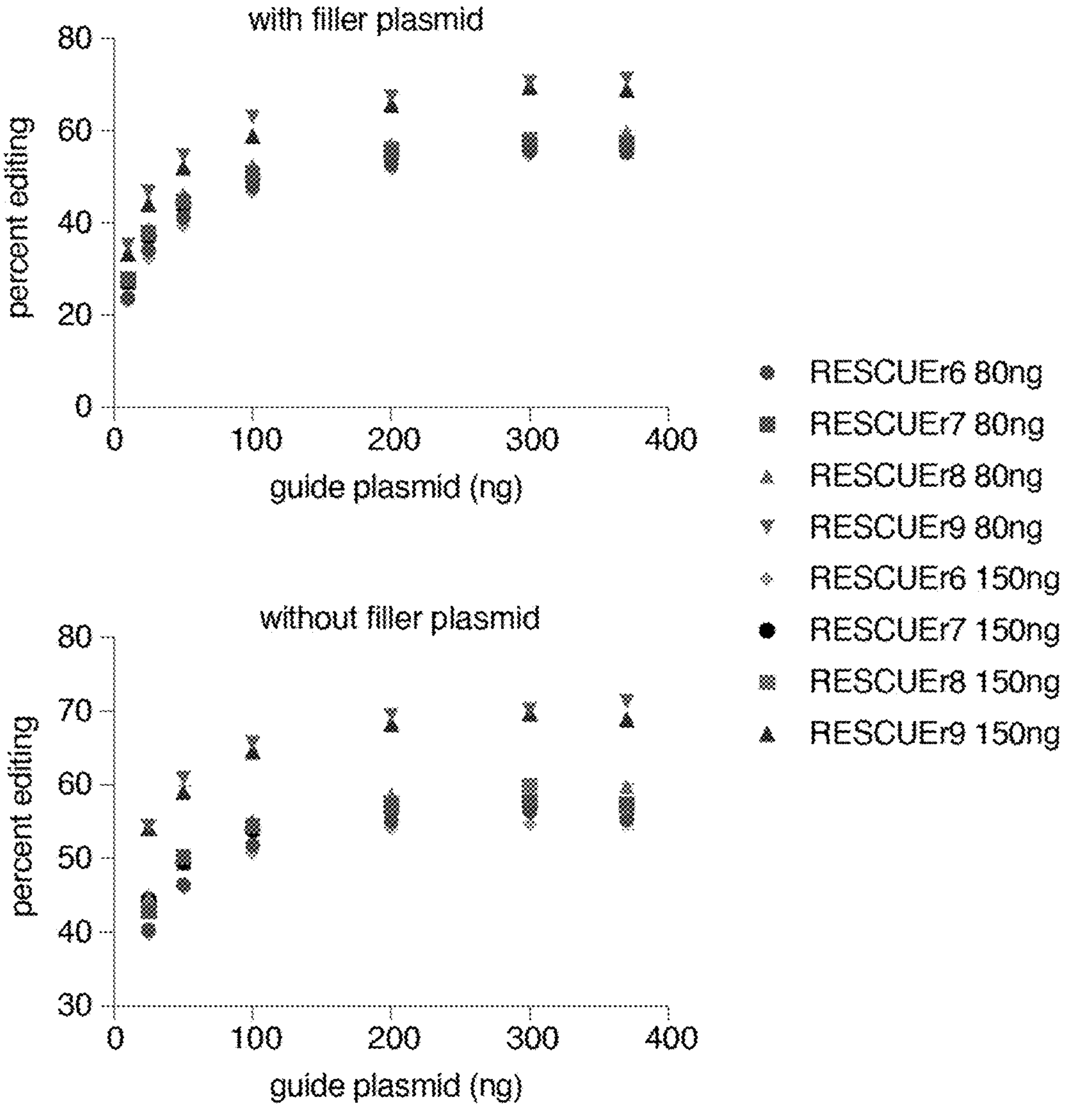
FIG. 112 Percent editing of a UCG site in the Gluc transcript by RESCUEr6-r9 at varying guide and RESCUE plasmid amounts. Values represent mean+/−S.E.M (n=3).
Figure 113A:
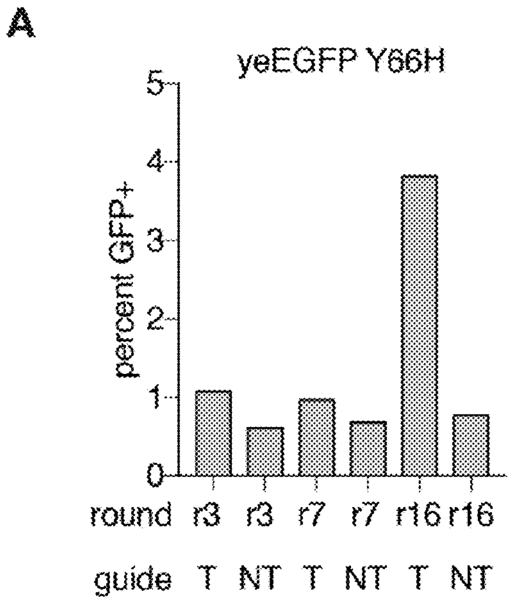
FIGS. 113A-113E Editing rates of various yeast reporters for directed evolution.
Figure 113B:
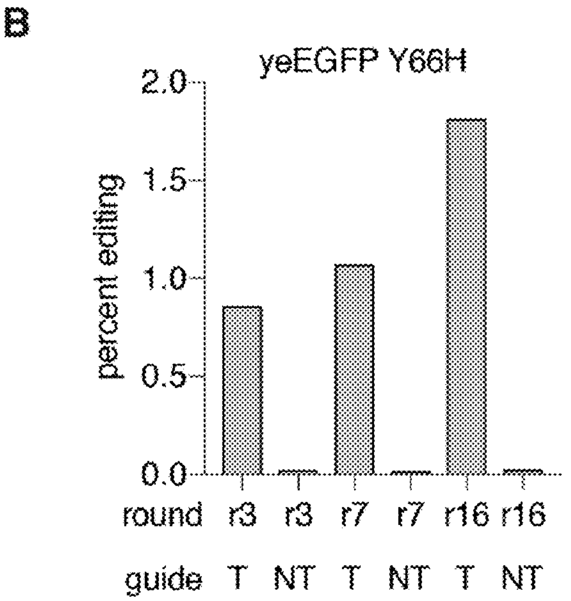
Figure 113C:
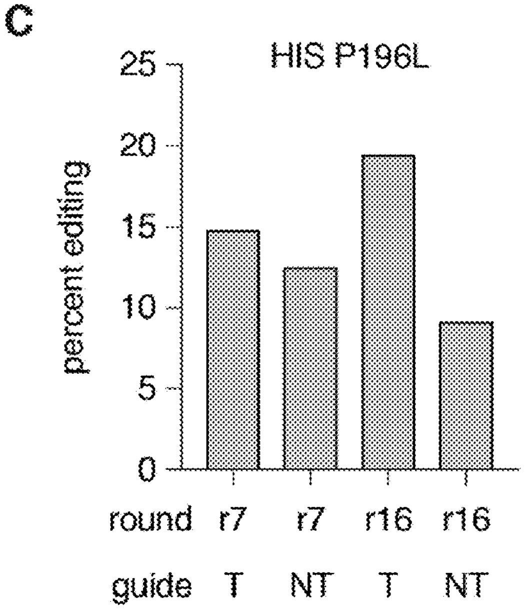
Figure 113D:
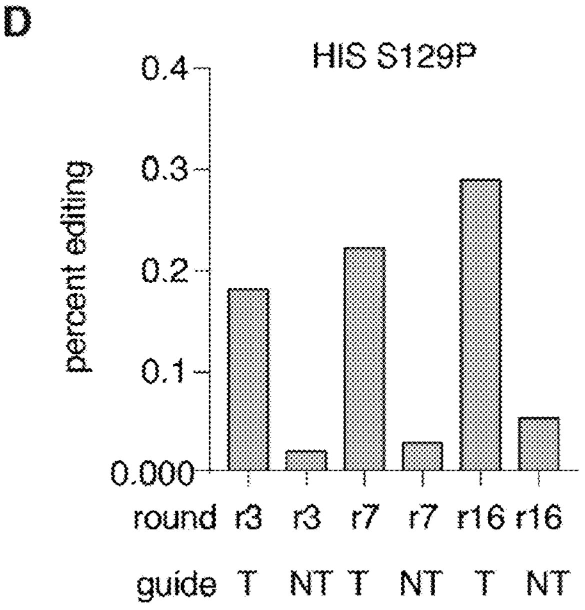
Figure 113E:
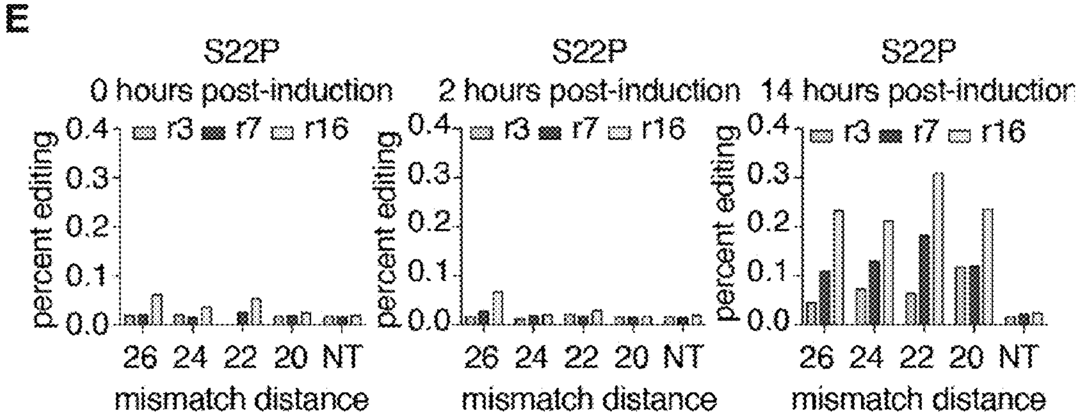
Figure 114A:
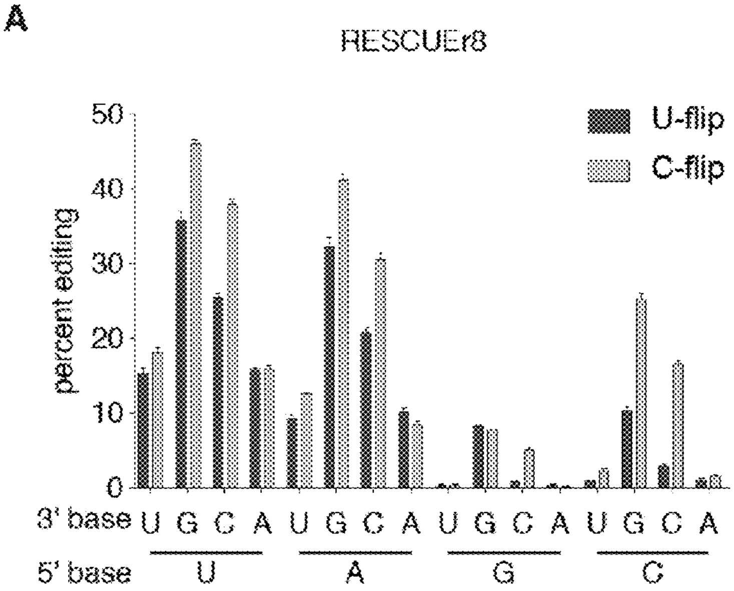
FIGS. 114A-114C Percent editing of Gluc sites with all 16 possible 5' and 3' base combinations with RESCUEr16 and r8 using guides with U, C, G, or A mismatches.
Figure 114B:
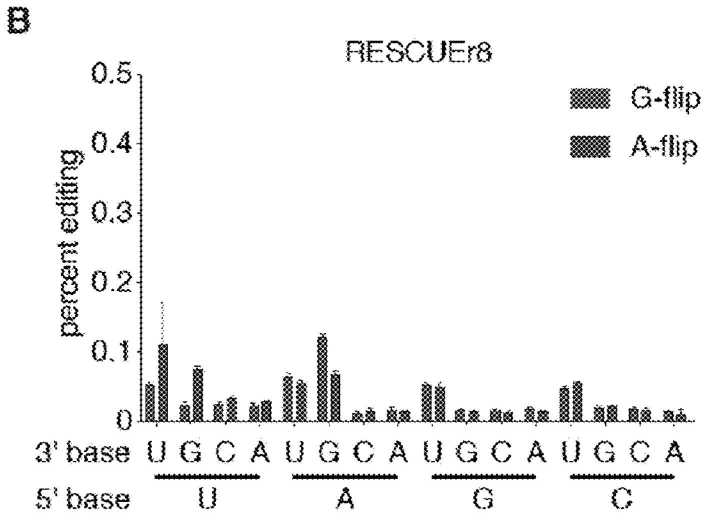
Figure 114C:
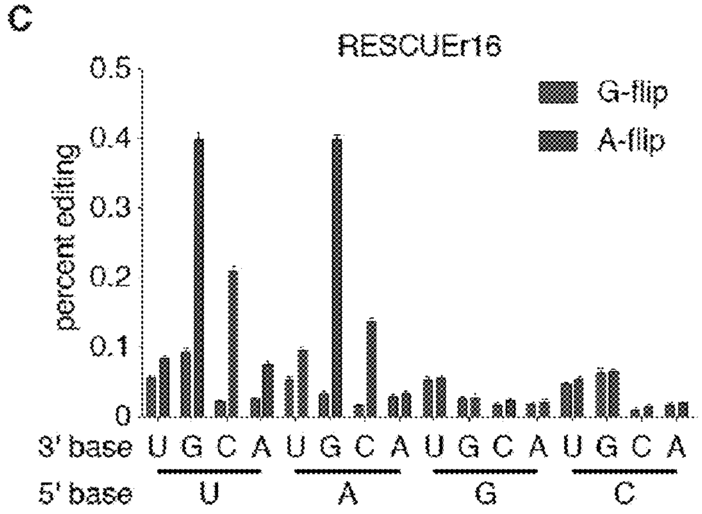
Figure 115:
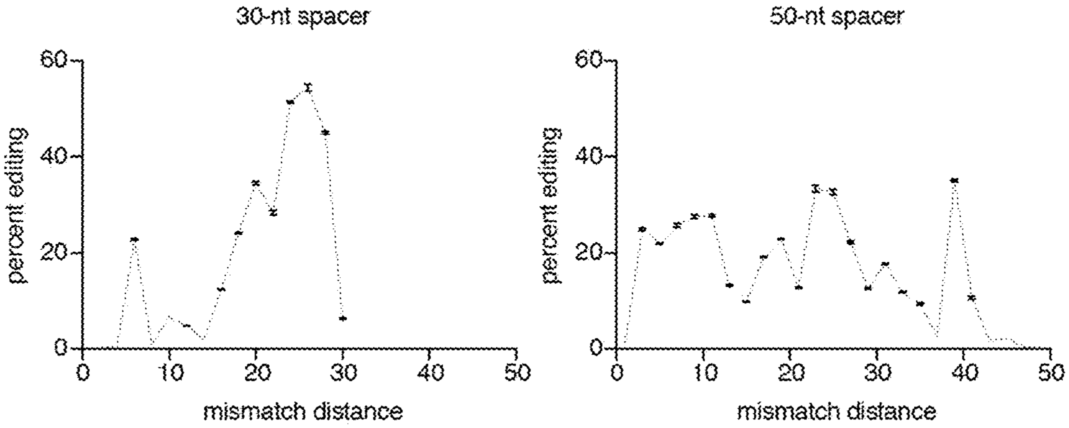
FIG. 115 Percent editing of RESCUE on a UCG site in the Gluc transcript with 30 bp and 50 bp guides with varying U mismatch positions. Values represent mean+/−S.E.M (n=3).

To select for C to U activity in yeast, Applicants engineered a set of yeast reporter assays based on either restoration of GFP fluorescence or prototrophic reversion of a HIS auxotrophic selection gene. Sequencing GFP positive cultures or colonies that survived in the absence of histidine elected individual mutations in the ADAR2dd domain, which were introduced onto the previous RESCUE candidate round and evaluated for activity in mammalian cells using various reporter constructs. After optimizing luciferase activity on the UCG luciferase site (C82R) for 11 rounds, Applicants switched to optimizing at the T41 site on the CTNNB1 transcript for two rounds and then the CCU site (L77P) on the Gluc transcript for another two rounds. In the final round, Applicants tested for restoration of activity of luciferase mutants with all four possible 5' bases at the Gluc C82R site (UCG, ACG, CCG, and GCG) and two additional motifs (CCU and CCA) at the Gluc L77P mutation, finding increases in activity with these motifs (FIGS. 103B, FIG. 110). To further validation our RESCUEr versions from the directed evolution pipeline in our yeast system, Applicants tested multiple RESCUEr iterations for both activity in yeast and in vitro assays (FIGS. 113A-113E and 120A-120D). Testing both EGFP and His restoration in yeast, Applicants found that later versions of RESCUEr could more effectively perform C to U editing on both targets (FIGS. 113A-113E). After each round of yeast screening, top mutations were evaluated on a series of mammalian reporters to validate activity and select the top mutant for the next round of yeast screening. All screens and resulting mutations are listed in Table 27.

Generation of Mutagenesis Libraries for Yeast Screening

To generate mutagenesis libraries for screening mutations in yeast systems, the hADAR2 deaminase domain was mutated using Genemorph II (Agilent Technologies) for error-prone PCR across eight 50 mL reactions ranging in template input from 74 ng-9.4 μg via a two-fold dilution series. Following amplification, reactions were pooled, diluted 1:4 in DI water and loaded into a 2% gel containing ethidium bromide. Extracted samples were purified using a MinElute PCR Purification Kit (Qiagen) before treatment with Dpn1 (Thermo Fisher Scientific) at 37° C. for 2 h to remove residual template plasmid and subsequent gel and MinElute purification. The backbone for cloning was generated by digesting 7 μg of template plasmid with KflI, RruI, and Eco72I (Thermo Fisher Scientific) for 1 hour. The digest was gel purified with the MinElute PCR Purification kit and eluted in 30 μL of pre-warmed water.

The purified PCR insert and digested backbone were assembled using Gibson Assembly (New England Biosciences), with 456 ng of PCR insert and 800 ng of backbone digest incubated in an 80 μL reaction for 1 hour. The product was pelleted with isopropanol precipitation and resuspended in 12 μL of Tris-EDTA buffer via heating to 50° C. for 5 minutes. 50 μL of Endura Electrocompetent cells (Lucigen) were thawed on ice for 10 minutes and 2 μL of resuspended Gibson product was added. The mixture was electroporated using a GenePulser Xcell (Bio-Rad) following optimal Endura settings (1.0 mm cuvette, 10 μF, 600 Ohm, 1800 V). Samples from each electroporation were recovered in 1 mL of Recovery Media (Lucigen) and incubated at 37° C. for 1 hour while shaking at 300 r.p.m. Two electroporations were performed per mutagenesis library. The recovered culture was plated on a large pre-warmed 100 μg/mL ampicillin plate, and plates were incubated at 37° C. for 16 hours before harvesting with the Nucleobond Xtra Maxi Kit (Macherey-Nagel).

Transformation of Mutagenesis Libraries in Yeast

All yeast experiments were performed using INVSc1 (ThermoFisher Scientific). Large scale yeast transformation was carried out as previously described (32). Briefly, colonies containing the Y66H EGFP or HIS3 reporter plasmids were picked into 300 mL-Trp 2% glucose selection media and grown up overnight at 30° C. After growth, the OD600 of the cells were determined and 2.5e9 cells were added to 500 mL of pre-warmed 2×YPAD and incubated for 4 hours at 30° C. The cell pellet was washed multiple times and then resuspended in 36 mL of transformation mix containing 24 mL of PEG 3350 (50% w/v), 3.6 mL of 1.0 M Lithium acetate, 5 mL of denatured single-stranded carrier salmon sperm DNA at 2.0 mg/mL (ThermoFisher Scientific), 2.9 mL of water, and 500 μL of 1 μg/μL plasmid library. After incubation at 42° C. for 60 minutes, the cell pellet was resuspended in 750 mL of −Ura/−Trp 2% glucose selection media and grown overnight until the culture reached OD600 of 5-6. At that point, 6 mL of the culture was seeded into 250 mL of 2% raffinose −Ura/−Trp selection media and incubated until the OD600 was 0.5-1. Cultures were induced by adding 27 mL of 30% galactose and incubated overnight at 30° C. for 12-14 hours. Cells were then either subjected to cell sorting or plating on selection plates, as described below. Any validation experiments involving single mutants were transformed in a similar way, but using a scaled down version of the large-scale transformation above.

Fluorescent Cell Sorting of Yeast Libraries

After induction, cells were sorted on a SH800S Cell Sorter by gating for EGFP fluorescence compared to a negative non-induced and non-targeting guide control. After 100 million cells had been sorted into 2% glucose −Ura/−Trp selection media, sorted cells were incubated overnight and then diluted 1:40 into 2% raffinose −Ura/−Trp selection media at an OD600 of 5-6. Cells were returned to the shaker, induced with galactose at an OD600 between 0.5-1, and incubated overnight for 12-14 hours before sorting again. Sorting was performed until 10-20 million cells had been sorted. Iterative growth and sorting was repeated 2-3 additional times, with each iteration of sorted cells harvested for plasmid with Zymoprep Yeast Plasmid Miniprep II (Zymo). The Adar2dd region of the plasmid was PCR amplified and sequenced by Ilumina NextSeq NGS to ascertain the mutants present at each round of selection. Top enriched mutants were individually ordered and cloned for mammalian validation testing as described below.

His Growth Selection of Yeast Libraries

After induction, the cell library was plated on 2% raffinose/3% galactose −Ura/−Trp/−His selection plates. As colonies grew, they were picked into water and streaked on 2% raffinose/3% galactose −Ura/−Trp/−His selection plates. After overnight growth of the streaks, colony PCR was performed on each streak and subjected to sanger sequencing of the ADAR2 catalytic domain as well as the His gene to check for recombination and DNA mutagenesis. Mutations were individually ordered and cloned for mammalian validation testing as described below.

Design and Cloning of Mammalian Constructs for RNA Editing

RanCas13b was made catalytically inactive (dRanCas13b) via histidine to alanine and arginine to alanine mutations (R142A/H147A/R1039A/H1044A) at the catalytic site of the HEPN domains. The deaminase domain and ADAR2 were synthesized and PCR amplified for Gibson cloning into pcDNA-CMV vector backbones and were fused to dRanCas13b at the C-terminus via a GS-mapkNES-GS (GSSLQKKLEELELGS (SEQ ID NO:779)) linker. Mutations in the ADAR2 deaminase domain for altering cytosine deamination activity or specificity were introduced by Gibson cloning into the dRanCas13b-GS-mapkNES-GS-ADAR2dd backbone. All mutations introduced into ADAR2dd for evolving C to U editing are listed in Table 27.

For comparison between different Cas13b orthologs, mutations tested on the dRanCas13b backbone were transferred to a dPspCas13b fusion vector by Gibson cloning onto the REPAIR construct (7), dPspCas13b-GS-HIVNES-GS-ADAR2dd. For testing the ADAR2dd alone without dRanCas13b and the full length ADAR2, Applicants used Gibson cloning to add all mutations to pcDNA-CMV vector backbones with ADAR2dd or full length ADAR2, previously cloned to test REPAIR (7). Luciferase reporter vectors for measuring C to U RNA editing activity were generated by screening potential mutations in Gluc in the previously reported luciferase reporter plasmid (7). This reporter vector expresses functional Cluc as a normalization control, but a defective Gluc due to the addition of mutants (either C82R or L77P). To test RESCUE editing motif preferences, Applicants cloned every possible motif around the cytosine at codon 82 (AAX CXC) of Gluc. Mutants were evaluated for C to U editing of C82R and restoration of catalytic activity (33). As the surrounding motif strongly determines RNA editing efficiency for A to I editing (7), Applicants initially targeted a UCG site since a 5'U and 3'G are the preferred flanking bases for ADAR2dd optimal activity. Secreted luciferase reporter vectors for testing CTNNB1 editing efficiency were generated from M50 Super 8× TOPFlash (Addgene #12456) and M50 Super 8× FOPFlash (Addgene #12457) (34). The original firefly luciferase, under control of either TCF/LEF responsive elements (TOPFlash) or mock binding sites (FOPFlash) was replaced with a secreted *Gaussia* luciferase via Gibson cloning. An additional Cypridina luciferase with expression drive by a CMV promoter was cloned in to serve as a transfection control. All mammalian plasmids are listed in Table 32.

Selection of Candidate Rounds in Mammalian Cells

Mutations that performed comparable or better to the existing candidate round were selected for screening on the entire panel of 6 luciferase reporters. For the selection of RESCUEr4 through RESCUEr10, candidate mutations were initially screened on TCG motifs; candidate round RESCUEr11 was isolated using GCG motifs as the initial screening. Selection of candidate rounds RESCUEr12 through RESCUEr14 were validated in mammalian cells using an initial screening on editing of the T41I residue of endogenous CTNNB1, resulting in 0-catenin pathway activation that was profiled with luminescent reporters of pathway activity, and candidate rounds RESCUEr15 and RESCUEr16 were selected via activity on the L77P CCT motif of Gluc. All rounds and yeast screens used to generate them are listed in Table 27.

Cloning Pathogenic U>C Mutations for Assaying RESCUE Activity

To generate disease-relevant mutations for testing REPAIR activity, 23 U>C mutations related to disease pathogenesis, as defined in ClinVar, were selected (grouped as a panel of 22 genes and ApoE independently). Selected targets were ordered from Integrated DNA Technologies as 200-bp regions surrounding the mutation site, and were cloned downstream of mScarlet under a Ef1alpha promoter.

Guide Cloning for RESCUE

For expression of mammalian guide RNAs for RESCUE, a previously described construct (7) with a RanCas13b direct repeat sequence preceded by golden-gate acceptor sites under U6 expression was used. Individual guides were cloned into this expression backbone by golden-gate cloning. To determine optimal guides for select sites, both C and U flips were tested, as well as tiling guides around the most common optimal guide range (mismatch distance of ~24). Guide sequences for RESCUE experiments are listed in Tables 29-31.

Mammalian Cell Culture

Unless otherwise stated, mammalian cell culture experiments were performed in the HEK293FT line (American Type Culture Collection (ATCC)), grown in Dulbecco's Modified Eagle Medium containing glucose, sodium pyruvate, and GlutaMAX (Thermo Fisher Scientific), and supplemented with 1×penicillin-streptomycin (Thermo Fisher Scientific) and 10% fetal bovine serum (VWR Seradigm). Cells were maintained at confluency below 80%.

Unless otherwise noted, all transfections were performed with Lipofectamine 2000 (Thermo Fisher Scientific) in 96-well plates coated with poly-D-lysine (BD Biocoat). Cells were plated at approximately 20,000 cells/well 16 hours prior to transfection to ensure 90% confluency at the time of transfection. For each well on the plate, transfection plasmids were combined with Opti-MEM I Reduced Serum Medium (Thermo Fisher Scientific) to a total of 25 µl. Separately, 24.5 µl of Opti-MEM was combined with 0.5 µl of Lipofectamine 2000. Plasmid and Lipofectamine solutions were then combined and incubated for 5 minutes, after which they were pipetted onto cells.

HUVEC cells (Lonza) were cultured in Endothelial Growth Media-2 (Lonza) on Nunc Collagen I Coated EasYFlasks (Thermo Fisher Scientific). Cells were maintained at confluency below 80%. HUVEC transfections were performed with Lipofectamine LTX (Thermo Fisher Scientific) in 96-well plates coated with Collagen I (BD Biocoat). Cells were plated at approximately 5,000 cells/well 16 hours prior to transfection. Culture media was replaced with fresh EGM-2 immediately before transfection. For each well on the plate, transfection plasmids were combined with 1 µL Plus reagent and Opti-MEM to a total of 25 µL. Separately, 24.7 µL of Opti-MEM was combined with 0.3 µL of Lipofectamine LTX. Plasmid and LTX solutions were then combined and incubated for 25 minutes, after which they were pipetted onto cells. After 4 hours, cells were washed with PBS and media was replaced with fresh EGM-2.

RESCUE Editing in Mammalian Cells

To assess RESCUE activity in mammalian cells, Applicants transfected 150 ng of RESCUE vector, 300 ng of guide expression plasmid, and, when using a reporter (either luciferase, STAT activity, or β-catenin activity), 40 ng of the RNA editing reporter. After 48 hours, RNA from cells was harvested and reverse transcribed using a method previously described (33) with a gene specific reverse transcription primer. The extracted cDNA was then subjected to two rounds of PCR to add Illumina adaptors and sample barcodes using NEBNext High-Fidelity 2×PCR Master Mix (New England Biolabs). The library was then subjected to next generation sequencing on an Illumina NextSeq or MiSeq. RNA editing rates were then evaluated at all adenosines within the sequencing window.

In experiments where the luciferase reporter was targeted for RNA editing, Applicants also harvested the media with secreted luciferase prior to RNA harvest. Applicants measured luciferase activity with Cypridinia and *Gaussia* luciferase assay kits (Targeting Systems) on a plate reader (Biotek Synergy Neo2) with an injection protocol. All replicates performed are biological replicates.

In experiments where the input amount of RESCUE plasmid was varied, total plasmid amount was kept constant by replacing RESCUE expression plasmid with a filler plasmid expressing a CMV-driven mScarlet, except where noted. In the experiment where input amount of guide plasmid was varied, total plasmid amount was either kept constant ("with filler plasmid") via substitution of non-targeting guide, or not kept constant ("without filler plasmid"); in this experiment, there was no filler plasmid for the RESCUE plasmid.

Considerations for RESCUE Guide Design

Applicants tested a panel of guide RNAs with varying mismatch positions targeting 24 different sites across nine genes (FIGS. 103E, 125A-125C), specifically choosing varying 5' base identities to interrogate the deamination activity on different motifs. Applicants found that RESCUE achieved editing rates up to 35% at all sites tested, and that the ideal mismatch position or base-flip (C or U) was site dependent. Moreover, RESCUE outperformed all previous rounds of mutants on multiple endogenous sites and required less transfected plasmid than earlier versions (FIGS. 126A-126B). To better evaluate the relevance of RESCUE for therapeutics, Applicants designed a series of 24 targets to model editing of disease-relevant mutations from ClinVar (see Table 28), and found editing rates up to 42% as measured by bulk sequencing (FIGS. 129A-129B), including the Alzheimer's risk related ApoE4 allele (FIG. 128).

After analyzing all guides in the paper, Applicants found that the optimal guide design differs between target sites. Applicants recommend testing a variety of guide designs per new target site including both C and U flips as well as varying mismatch positions. An example of designs to test would include a 30 nt guide with C or U flip and mismatches in the following positions: 28, 26, 24, 22, and 20. Overall, Applicants find that any cytidine site that is flanked by a U or A will have robust editing activity. Sites with a 5' C or G will be edited with less efficiency.

Biochemical Characterization of RESCUE Mutations on ADAR2dd

To assess kinetic activity of hADAR2 deaminase domain containing RESCUE mutations, multiple iterations were cloned into a pGAL-His6-TwinStrep-SUMO-hADAR2dd backbone containing the URA3 gene. The plasmids were transformed into BCY123 competent yeast cells (10). Briefly, frozen cells were thawed in 37° C. water bath for 15-30 seconds. 10 µL of cells per condition were centrifuged at 13,000 g in a microcentrifuge for 2 minutes and supernatant was removed. The prepared transformation mix for each construct contained 260 µL PEG 3350 prepared at 50% w/v, 50 µL of denatured salmon sperm (Thermo Fisher Scientific), 36 µL 1M Lithium Acetate, and 750 ng of plasmid in 14 µL of DI H2O. The yeast pellet was resuspended with the transformation mix and incubated in a 42° C. water bath for 30 minutes before centrifugation at 13,000 g for 30 seconds and subsequent supernatant removal. The pellet was then resuspended in 1 mL of DI H2O and 50 μL was taken into 1 mL of DI H2O for mixing. Subsequently, 200 μL was plated onto minimal glucose plates minus uracil for prototrophic selection.

Plates were incubated at 30° C. for 48 hr before seeding single colonies into 10 mL cultures of yeast minimal media supplemented with dextrose (20 g/L). Minimal media was prepared with yeast dropout supplement Y2001 (1.39 g/L), yeast nitrogen base without amino acids (6.7 g/L), adenine hemisulfate (0.022 g/L), histidine (0.076 g/L), leucine (0.38 g/L), and tryptophan (0.076 g/L). Cultures were grown overnight before seeding the entire 10 mL culture into a 100 mL minimal media/dextrose culture. Following 8 hours of growth, each construct was seeded into two 2 L flasks containing 1 L of minimal media supplemented with 20 g of raffinose (VWR). These were grown overnight and induced by the addition of 30 g of galactose dissolved in 200 mL of minimal media; cultures were then grown for an additional eight hours before harvesting. Cultures were spun down in a Beckman Coulter Avanti J-E centrifuge at 5,000 RPM for 20 minutes, the resulting pellets were stored at −80° C.

Protein purification of the different RESCUE candidate hADAR2 deaminase domains was modified from the protocol described in Macbeth and Bass (28). In brief, 5-10 g of frozen yeast pellet was resuspended in 50 mL lysis buffer Lysis buffer (20 mM TrisHCl pH 8, 5% glycerol, 750 mM NaCl, 1 mM beta-mercaptoethanol, 0.01% Triton-X) supplemented with one tablet of EDTA-free mini cOmplete ULTRA protease inhibitors (Sigma). The suspension was passed seven times through a LM20 microfluidizer at 25,000 psi, and the cell debris was pelleted by centrifugation at 9,500 RPM for 80 minutes. The cleared lysate was decanted off and incubated with 1 mL of StrepTactin superflow resin (Qiagen) for 2.5 hours, gently shaking using a rotary shaker at 4° C. The suspension was added to an Econo-column chromatography column pre-equilibrated with lysis buffer, and the resin was washed with 40 mL of lysis buffer. Three subsequent washes (40 mL each) lowered the salt concentration (500 mM, 250 mM, then 100 mM NaCl). Protein was cleaved off the resin by gently shaking overnight on a table shaker in 20 mL of lysis buffer supplemented with 100 μg of SUMO protease (in-house). Flow-through was collected and combined with 3×5 mL washes of the resin with lysis buffer. The entire fraction containing cleaved protein was loaded onto a 5 mL Heparin HP cation exchange column (GE Healthcare Life Sciences), and eluted over a NaCl gradient from 100 mM to 1 M (buffers 20 mM Tris-HCl pH 8, 5% glycerol, 1 mM beta-mercaptoethanol with respective NaCl concentration). Fractions were checked for purity and analyzed using SDS-PAGE and Coomassie staining, and protein containing fractions were pooled and concentrated using 10 MWCO centrifugal filters (Amicon). The concentration in mg/mL of each protein was determined by Coomassie staining and SDS-PAGE electrophoresis against a serial dilution of BSA (starting at 1 mg/mL). Bands were quantified using ImageLab software (BioRad Image Lab Software 6.0.1), and the concentration was estimated by interpolation of a linear regression of the BSA standard.

ssRNA and DNA oligonucleotides with DNA handles (Integrated DNA Technologies) were annealed in 1×duplex buffer (HEPES 30 mM pH 7.5, K+Acetate 100 mM) at 85° C. for 5 minutes with a slow ramp to 4° C., then purified using Oligo Clean & Concentrator (Zymo), quantified with a Nanodrop, and normalized to 100 ng/μL.

In vitro assays were performed as previously described (23) with slight modifications. Assays were set up on ice with 25 nM RNA substrate, 50 nM ADAR protein, and 0.16 U/uL RNase inhibitor, and 15.6 mM NaCl in 1×assay buffer (17 mM TrisHCl pH 7.5, 5% glycerol, 1.6 mM EDTA, 0.003% NP-40, 0.5 mM TCEP). 20 μL reactions (with three technical replicates) were incubated at 30° C. for a range of timepoints (0, 5, 10, 30, and 60 minutes). Reactions were quenched by the addition of 10 μL of 0.5% SDS solution (to a total concentration of 0.166% SDS), and denatured for 5 minutes at 95° C.

RNA was purified from the reaction mixture using RNA XP clean beads (Beckman Coulter) with 10:3 and 3:1 ratios of magnetic beads and isopropanol to sample volume, respectively. Purified RNA was reverse transcribed using the qScript Flex cDNA kit according to manufacturer specifications with modifications. Specifically, 12.85 μL of purified RNA was combined with 2 μL of GSP enhancer and 0.15 μL of 100 μM RT primer, mixed by vortexing and incubated at 65° C. for 5 minutes before entering a 42° C. hold. At this point 4 μL of qScript flex reaction mastermix (5×) and 1 μL of qScript RT were added to each reaction and mixed by pipetting followed by a one hour incubation at 42° C., then heating at 85° C. for 5 minutes. The cDNA was prepared for sequencing with two rounds of PCR amplification to add Illumina adaptors and barcodes and was sequenced on an Illumina NextSeq. Rates of in vitro RNA editing were determined at all cytidines (for C-to-U activity) and adenosines (for A-to-I activity) within the sequencing window.

Whole-Transcriptome Sequencing to Evaluate ADAR Editing Specificity

For analyzing off-target RNA editing sites across the transcriptome, total RNA from cells was harvested 48 hours post-transfection using the RNeasy Plus Miniprep kit (Qiagen). The mRNA fraction was then enriched using a NEBNext Poly(A) mRNA Magnetic Isolation Module (NEB) and this RNA was then prepared for sequencing using an NEBNext Ultra RNA Library Prep Kit for Illumina (NEB). The libraries were then sequenced on an Illumina NextSeq and loaded such that there were at least 5 million reads per sample.

RNA Editing Analysis for Targeted and Transcriptome-Wide Experiments

Analysis of the transcriptome-wide editing RNA sequencing data was performed on the FireCloud computational framework (software.broadinstitute.org/firecloud/) using a custom workflow developed for this publication: portal.firecloud.org/#methods/m/rna_editing_final_workflow/rna_editing_final_workflow/1.

For analysis, unless otherwise denoted, sequence files were randomly down sampled to 5 million reads. An index was generated using the RefSeq GRCh38 assembly with Gluc and Cluc sequences added, and reads were aligned and quantified using Bowtie/RSEM version 1.3.0. Alignment BAMs were then sorted and analyzed for RNA editing sites using REDitools (35, 36) with the following parameters: -t 8 -e -d -l -U [AG or TC or CT or GA]-p -u -m20 -T6-0 -W -v 1-n 0.0. Any significant edits found in untransfected or EGFP-transfected conditions were considered to be SNPs or artifacts of the transfection and filtered out from the analysis of off-targets. Off-targets were considered significant if the Fisher's exact test yielded a p-value less than 0.05 after multiple hypothesis correction by Benjamini Hochberg correction and at least 2 of 3 biological replicates identified the edit site. Overlap of edits between samples was calculated relative to the maximum possible overlap, equivalent to the fewer number of edits between the two samples. The percentage of overlapping edit sites was calculated as the number of shared edit sites divided by minimum number of edits of the two samples, multiplied by 100. An additional layer of filtering for known SNP positions was performed using the Kaviar (37) method for identifying SNPs.

Differential Gene Expression Analysis of RNA Editing

Bowtie index was created based on the human hg38 UCSC genome and RefSeq transcriptome. Next, RSEM v1.3.157 was run with command line options "- -estimate- -bowtie-chunkmbs 512- -paired-end" to align paired-end reads directly to this index using Bowtie and estimate expression levels in transcripts per million (TPM) based on the alignments. For analysis of transcriptome changes, transcripts were considered detected if the average TPM of either the RESCUE or GFP control conditions was greater than 1. The Student's t-test was performed to identify differentially expressed isoforms that had p-value pass 0.01 FDR correction.

Stat Phenotype Assay

Cells were transfected with RESCUE plasmids, guide plasmids targeting residues on STAT3 and STAT1, and a luciferase reporter for STAT3 (Qiagen Cignal STAT3 Reporter) and STAT1 signaling (Qiagen Cignal GAS Reporter) using lipofectamine 2000, as described above and incubated for 48 hours. After 48 hours, the Dual-Glo Luciferase Assay (Promega) was used to measure firefly and *renilla* luciferase activity in the cells. The firefly signal was normalized to the *renilla* signal to measure the relative activation of STAT3 and STAT1.

β-Catenin Phenotype Assay

Cells were plated 24 hours prior to transfection in cell migration plates containing cores that prevent cell growth in the center of the well. After 24 hours, cells were transfected with RESCUE plasmids, guide plasmids targeting residues on β-catenin, and a luciferase reporter for β-catenin activation (Qiagen TCF/LEF Cignal Reporter) using lipofectamine 2000, as described above and incubated. After 24 hours, central cores were removed to allow for cell growth towards the center of the well. After another 24 hours of incubation, media was assayed for Gluc and Cluc luciferase signal. The relative ratio of Gluc to Cluc was calculated to determine the relative β-catenin activation between conditions. On day 3 cells were incubated for 10 minutes with CellTracker Green CMFDA Dye (ThermoFisher Scientific) and then washed with media. Cells were imaged daily using fluorescence to measure cell growth. Cell growth into the central area of the well was measured using ImageJ software by calculating the total area of fluorescence in the central growth region. Images were processed using an automated macro with the following commands:

```
//ImageJ macro for calculating cellular area run("8-bit");
  run("Auto Local Threshold", "method=Bernsen radius=15 parameter 1=0
parameter_2-0 white");
  setAutoThreshold("Default dark"); run("Measure");
```

Catenin Migration Assay (HUVECs)

HUVECs were plated on Collagen I-coated cell migration plates 16 hours prior to transfection. 100 ng of a single vector, containing both the RESCUE construct and guide, were used in the transfection protocol described above. After 24 hours, central cores were removed and media was replaced with Endothelial Basal Media-2 (Lonza) supplemented with hydrocortisone, hFGF-B, FBS, ascorbic acid, GA-1000, and heparin from EGM-2 Supplement Pack (Lonza). On day 3, cells were incubated for 10 minutes with CellTracker Green CMFDA Dye diluted in EBM-2 and then washed with media. Cells were imaged daily using fluorescence. Cell growth was measured using ImageJ software by manually outlining and quantifying the cell-free area in each well.

TABLE 27

RESCUE evolution table

| RESCUE candidate round | Mutations | Screening method for generation of candidate mutations | Mammalian editing target |
|---|---|---|---|
| r0 (REPAIR) | ADAR2 + E488Q | Hyper active variant from Kuttan and Bass | N/A |
| r1 | r0 + V351G | Rational mutagenesis | CCG site on Gluc transcript (C82R) |
| r2 | r1 + S486A | Rational mutagenesis | CCG site on Gluc transcript (C82R) |
| r3 | r2 + T375S | Rational mutagenesis | CCG site on Gluc transcript (C82R) |
| r4 | r3 + S370C | Y66H EGFP | CCG site on Gluc transcript (C82R) |
| r5 | r4 + P462A | P196L HIS | CCG site on Gluc transcript (C82R) |
| r6 | r5 + N597I | P196L HIS | CCG site on Gluc transcript (C82R) |
| r7 | r6 + L332I | P196L HIS | CCG site on Gluc transcript (C82R) |
| r8 | r7 + I398V | P196L HIS | CCG site on Gluc transcript (C82R) |
| r9 | r8 + K350I | P196L HIS | CCG site on Gluc transcript (C82R) |
| r10 | r9 + M383L | P196L HIS | CCG site on Gluc transcript (C82R) |
| r11 | r10 + D619G | S22P HIS | CCG site on Gluc transcript (C82R) |
| r12 | r11 + S582T | S22P HIS | T41I on endogenous β-catenin |
| r13 | r12 + V440I | S22P HIS | T41I on endogenous β-catenin |
| r14 | r13 + S495N | P196L HIS | CCT site on Gluc transcript (L77P) |
| r15 | r14 + K418E | P196L HIS | CCT site on Gluc transcript (L77P) |
| r16 (RESCUE) | r15 + S661T | S22P HIS | UCG, ACG, GCG, CGC sites on Gluc transcript (C82R), CCT and CCA sites on Gluc transcript (L77P), and T41I on endogenous β-catenin |

TABLE 28

Disease information for disease-relevant mutations

| Candidate | Gene | Diseases |
| --- | --- | --- |
| NM_000071.2(CBS): c.325T > C (p.Cys109Arg) | CBS | Thoracic aortic aneurysm and aortic dissection |
| NM_000141.4(FGFR2): c.799T > C (p.Ser267Pro) | FGFR2 | Pfeiffer syndrome/Crouzon syndrome/Neoplasm of stomach |
| NM_000551.3(VHL): c.473T > C (p.Leu158Pro) | VHL | Von Hippel-Lindau syndrome |
| NM_002474.2(MYH11): c.3791T > C (p.Leu1264Pro) | MYH11 | Aortic aneurysm, familial thoracic 4/Thoracic aortic aneurysm and aortic dissection |
| NM_000018.3(ACADVL): c.848T > C (p.Val283Ala) | ACADVL | Very long chain acyl-CoA dehydrogenase deficiency |
| NM_002397.4(MEF2C): c.2T > C (p.Met1Thr) | MEF2C | Mental retardation, stereotypic movements, epilepsy, and/or cerebral malformations |
| NM_002834.4(PTPN11): c.853T > C (p.Phe285Leu) | PTPN11 | Noonan syndrome |
| NM_005609.3(PYGM): c.2392T > C (p.Trp798Arg) | PYGM | Glycogen storage disease, type V |
| NM_001256850.1(TTN): c.90211T > C (p.Cys30071Arg) | TTN | Limb-girdle muscular dystrophy, type 2J/Distal myopathy Markesbery-Griggs type/Hereditary myopathy with early respiratory failure/Myopathy, early-onset, with fatal cardiomyopathy/Familial hypertrophic cardiomyopathy 9 |
| NM_005633.3(SOS1): c.806T > C (p.Met269Thr) | SOS1 | Noonan syndrome 4/Noonan syndrome |
| NM_015559.2(SETBP1): c.2612T > C (p.Ile871Thr) | SETBP1 | Schinzel-Giedion syndrome |
| NM_004572.3(PKP2): c.2386T > C | PKP2 | Arrhythmogenic right ventricular cardiomyopathy, |

TABLE 28-continued

Disease information for disease-relevant mutations

| Candidate | Gene | Diseases |
| --- | --- | --- |
| (p.Cys796Arg) | | type 9 |
| NM_000138.4(FBN1): c.4222T > C (p.Cys1408Arg) | FBN1 | Marfan syndrome |
| NM_000375.2(UROS): c.217T > C (p.Cys73Arg) | UROS | Congenital erythropoietic porphyria |
| NM_O14139.2(SCN11A): c.1187T > C (p.Leu396Pro) | SCN11A | not provided/Neuropathy, hereditary sensory and autonomic, type VII |
| NM_000152.4(GAA): c.1655T > C (p.Leu552Pro) | GAA | Glycogen storage disease, type II |
| NM_020630.4(RET): c.1858T > C (p.Cys620Arg) | RET | Multiple endocrine neoplasia, type 2a/Multiple endocrine neoplasia, type 2/MEN2A and FMTC |
| NM_000016.5(ACADM): c.199T > C (p.Tyr67His) | ACADM | Medium-chain acyl-coenzyme A dehydrogenase deficiency |
| NM_014874.3(MFN2): c.227T > C (p.Leu76Pro) | MFN2 | Charcot-Marie-Tooth disease, type 2A2A |
| NM_000341.3(SLC3A1): c.1400T > C (p.Met467Thr) | SLC3A1 | Cystinuria |
| NM_000431.3 (MVK): c.803T > C (p.Ile268Thr) | MVK | Mevalonic aciduria/Hyper-immunoglobulin D with periodic fever |
| NM_004004.5(GJB2): c.229T > C (p.Trp77Arg) | GJB2 | Deafness, autosomal recessive 1A/Deafness, autosomal dominant 3a/Nonsyndromic hearing loss and deafness |
| NM_000041.4(APOE): c.388T > C (p.Cys130Arg) | APOE | Alzheimer disease 2 |
| NM_000041.4(APOE): c.595T > C (p.Cys176Arg) | APOE | Alzheimer disease 2 |

TABLE 29

Guide sequences used for luciferase editing

| Name | Targeted gene | REPAIR/ RESCUE | Motif | Base flip/ position | Codon change | Spacer sequence | Notes | Editing percentage (first figure) | First figure |
|---|---|---|---|---|---|---|---|---|---|
| UCG targeting guide | Gluc | RESCUE | UCG | C/30/26 | C82R | gugcCauugaugugggacaggca gaucaga (SEQ ID NO: 780) | No 5' G | 67.493 | 103B |
| GCG targeting guide | Gluc | RESCUE | GCG | U/30/20 | C82R | guugggcgugcucuugauguggg acaggcag (SEQ ID NO: 781) | | 45.475 | 103B |
| ACG targeting guide | Gluc | RESCUE | ACG | C/30/28 | C82R | ggccuuugaugugggacaggcag aucagaca (SEQ ID NO: 782) | | 64.464 | 103B |
| CCG targeting guide | Gluc | RESCUE | CCG | C/30/26 | C82R | gugccguugaugugggacaggca gaucaga (SEQ ID NO: 783) | No 5' G | 62.947 | 103B |
| CCU targeting | Gluc | RESCUE | CCU | C/30/26 | L77P | gggaacggcagaucagacagccc cuggugca (SEQ ID NO: 784) | | 3.800 | 103B |
| CCA targeting | Gluc | RESCUE | CCA | C/30/26 | L77P | gggauuggcagaucagacagccc cuggugca (SEQ ID NO: 785) | | 4.509 | 103B |
| Motif guide UCU, flip U | Gluc | RESCUE | UCU | U/30/26 | L82F | gugaUauugaugugggacaggca gaucaga (SEQ ID NO: 786) | | 46.611 | 103C |
| Motif guide UCG, flip U | Gluc | RESCUE | UCG | U/30/26 | C82R | gugcUauugaugugggacaggca gaucaga (SEQ ID NO: 787) | | 57.945 | 103C |
| Motif guide UCC, flip U | Gluc | RESCUE | UCC | U/30/26 | P82S | guggUauugaugugggacaggca gaucaga (SEQ ID NO: 788) | | 57.165 | 103C |
| Motif guide UCA, flip U | Gluc | RESCUE | UCA | U/30/26 | H82Y | guguUauugaugugggacaggca gaucaga (SEQ ID NO: 789) | | 49.256 | 103C |
| Motif guide ACU, flip U | Gluc | RESCUE | ACU | U/30/26 | L82F | gugaUuuugaugugggacaggca gaucaga (SEQ ID NO: 790) | | 44.241 | 103C |
| Motif guide ACG, flip U | Gluc | RESCUE | ACG | U/30/26 | C82R | gugcUuuugaugugggacaggca gaucaga (SEQ ID NO: 791) | | 60.722 | 103C |
| Motif guide ACC, flip U | Gluc | RESCUE | ACC | U/30/26 | P82S | guggUuuugaugugggacaggca gaucaga (SEQ ID NO: 792) | | 58.056 | 103C |
| Motif guide ACA, flip U | Gluc | RESCUE | ACA | U/30/26 | H82Y | guguUuuugaugugggacaggca gaucaga (SEQ ID NO: 793) | | 40.921 | 103C |
| Motif guide GCU, flip U | Gluc | RESCUE | GCU | U/30/26 | L82F | gugaUcuugaugugggacaggca gaucaga (SEQ ID NO: 794) | | 4.603 | 103C |

TABLE 29-continued

Guide sequences used for luciferase editing

| Name | Targeted gene | REPAIR/ RESCUE | Motif | Base flip/ position | Codon change | Spacer sequence | Notes | Editing percentage (first figure) | First figure |
|---|---|---|---|---|---|---|---|---|---|
| Motif guide GCG, flip U | Gluc | RESCUE | GCG | U/30/26 | C82R | gugcUcuugaugugggacaggca gaucaga (SEQ ID NO: 795) | | 43.507 | 103C |
| Motif guide GCC, flip U | Gluc | RESCUE | GCC | U/30/26 | P82S | guggUcuugaugugggacaggca gaucaga (SEQ ID NO: 796) | | 11.006 | 103C |
| Motif guide GCA, flip U | Gluc | RESCUE | GCA | U/30/26 | H82Y | guguUcuugaugugggacaggca gaucaga (SEQ ID NO: 797) | | 4.239 | 103C |
| Motif guide CCU, flip U | Gluc | RESCUE | CCU | U/30/26 | L82F | gugaUguugaugugggacaggca gaucaga (SEQ ID NO: 798) | | 11.808 | 103C |
| Motif guide CCG, flip U | Gluc | RESCUE | CCG | U/30/26 | C82R | gugcUguugaugugggacaggca gaucaga (SEQ ID NO: 799) | | 51.692 | 103C |
| Motif guide CCC, flip U | Gluc | RESCUE | CCC | U/30/26 | P82S | guggUguugaugugggacaggca gaucaga (SEQ ID NO: 800) | | 28.402 | 103C |
| Motif guide CCA, flip U | Gluc | RESCUE | CCA | U/30/26 | H82Y | guguUguugaugugggacaggca gaucaga (SEQ ID NO: 801) | | 7.597 | 103C |
| Motif guide UCU, flip C | Gluc | RESCUE | UCU | C/30/26 | L82F | gugaCauugaugugggacaggca gaucaga (SEQ ID NO: 802) | | 49.430 | 103C |
| Motif guide UCC, flip C | Gluc | RESCUE | UCC | C/30/26 | P82S | guggCauugaugugggacaggca gaucaga (SEQ ID NO: 803) | | 59.973 | 103C |
| Motif guide UCA, flip C | Gluc | RESCUE | UCA | C/30/26 | H82Y | guguCauugaugugggacaggca gaucaga (SEQ ID NO: 804) | | 48.343 | 103C |
| Motif guide ACU, flip C | Gluc | RESCUE | ACU | C/30/26 | L82F | gugaCuuugaugugggacaggca gaucaga (SEQ ID NO: 805) | | 47.840 | 103C |
| Motif guide ACG, flip C | Gluc | RESCUE | ACG | C/30/26 | C82R | gugcCuuugaugugggacaggca (SEQ ID NO: 806) | | 70.120 | 103C |
| Motif guide ACC, flip C | Gluc | RESCUE | ACC | C/30/26 | P82S | guggCuuugaugugggacaggca gaucaga (SEQ ID NO: 807) | | 58.779 | 103C |
| Motif guide ACA, flip C | Gluc | RESCUE | ACA | C/30/26 | H82Y | guguCuuugaugugggacaggca gaucaga (SEQ ID NO: 808) | | 45.594 | 103C |
| Motif guide GCU, flip C | Gluc | RESCUE | GCU | C/30/26 | L82F | gugaCcuugaugugggacaggca gaucaga (SEQ ID NO: 809) | | 3.652 | 103C |
| Motif guide GCG, flip C | Gluc | RESCUE | GCG | C/30/26 | C82R | gugcCcuugaugugggacaggca gaucaga (SEQ ID NO: 810) | | 37.719 | 103C |

TABLE 29-continued

Guide sequences used for luciferase editing

| Name | Targeted gene | REPAIR/ RESCUE | Motif | Base flip/ position | Codon change | Spacer sequence | Notes | Editing percentage (first figure) | First figure |
|---|---|---|---|---|---|---|---|---|---|
| Motif guide GCC, flip C | Gluc | RESCUE | GCC | C/30/26 | P82S | guggCcuugaugugggacaggca gaucaga (SEQ ID NO: 811) | | 34.488 | 103C |
| Motif guide GCA, flip C | Gluc | RESCUE | GCA | C/30/26 | H82Y | guguCcuugaugugggacaggca gaucaga (SEQ ID NO: 812) | | 2.944 | 103C |
| Motif guide CCU, flip C | Gluc | RESCUE | CCU | C/30/26 | L82F | gugaCguugaugugggacaggca gaucaga (SEQ ID NO: 813) | | 16.647 | 103C |
| Motif guide CCC, flip C | Gluc | RESCUE | CCC | C/30/26 | P82S | guggCguugaugugggacaggca gaucaga (SEQ ID NO: 814) | | 48.269 | 103C |
| Motif guide CCA, flip C | Gluc | RESCUE | CCA | C/30/26 | H82Y | guguCguugaugugggacaggca gaucaga (SEQ ID NO: 815) | | 12.670 | 103C |
| Non-targeting guide | N/A | N/A | N/A | N/A | N/A | guaaugccuggcuugucgacgca uagucug (SEQ ID NO: 816) | | N/A | 104C |
| Gluc specificity guide with off-target A-G mismatch 1 | Gluc | RESCUE | UCG | C/30/26 | C82R | ggugcuaGugaugugggacagc agaucaga (SEQ ID NO: 817) | Additional G added specificity | 10.836 | 105D |
| Gluc specificity guide with off-target A-G mismatch 2 | Gluc | RESCUE | UCG | C/30/26 | C82R | ggugcuauGgaugugggacaggc agaucaga (SEQ ID NO: 818) | Additional G added specificity | 16.037 | 105D |
| Gluc specificity guide with off-target A-G mismatch 3 | Gluc | RESCUE | UCG | C/30/26 | C82R | ggugcuauugaugGgggacaggc agaucaga (SEQ ID NO: 819) | Additional G added specificity | 29.555 | 105D |
| Gluc specificity guide with off-target A-G combo 1 + 2 | Gluc | RESCUE | UCG | C/30/26 | C82R | ggugcuaGGgaugugggacaggc agaucaga (SEQ ID NO: 820) | Additional G added specificity | 1.533 | 105D |
| Gluc specificity guide with off-target A-G combo all | Gluc | RESCUE | UCG | C/30/26 | C82R | ggugcuaGGgaugGgggacaggc agaucaga (SEQ ID NO: 821) | Additional G added specificity | 0.412 | 105D |
| A to I REPAIR guide | Cluc | REPAIR | TAG | C/50/34 | *85W | gcgcccugugcggacuccuuguc gccuucguaggugguggcagcguc cuggg (SEQ ID NO: 822) | | N/A | 106A |

TABLE 29-continued

| Name | Targeted gene | REPAIR/ RESCUE | Motif | Base flip/ position | Codon change | Spacer sequence | Notes | Editing percentage (first figure) | First figure |
|---|---|---|---|---|---|---|---|---|---|
| Guide sequences used for luciferase editing | | | | | | | | | |
| Tiling guide 30 flip 30 U | Gluc | RESCUE | UCG | U/30/30 | C82R | guauugaugugggacaggcagau cagacagc (SEQ ID NO: 823) | | 6.327 | 115 |
| Tiling guide 30 flip 28 U | Gluc | RESCUE | UCG | U/30/28 | C82R | ggcuauugaugugggacaggcag aucagaca (SEQ ID NO: 824) | | 45.029 | 115 |
| Tiling guide 30 flip 26 U | Gluc | RESCUE | UCG | U/30/26 | C82R | ggugcuauugaugugggacaggc agaucaga (SEQ ID NO: 825) | | 54.433 | 115 |
| Tiling guide 30 flip 24 U | Gluc | RESCUE | UCG | U/30/24 | C82R | ggcgugcuauugaugugggacag gcagauca (SEQ ID NO: 826) | | 51.454 | 115 |
| Tiling guide 30 flip 22 U | Gluc | RESCUE | UCG | U/30/22 | C82R | ggggcgugcuauugaugugggac aggcagau (SEQ ID NO: 827) | | 28.375 | 115 |
| Tiling guide 30 flip 20 U | Gluc | RESCUE | UCG | U/30/20 | C82R | guugggcgugcuauugaugggg acaggcag (SEQ ID NO: 828) | | 34.460 | 115 |
| Tiling guide 30 flip 18 U | Gluc | RESCUE | UCG | U/30/18 | C82R | gucuugggcgugcuauugaugug ggacaggc (SEQ ID NO: 829) | | 24.148 | 115 |
| Tiling guide 30 flip 16 U | Gluc | RESCUE | UCG | U/30/16 | C82R | gcaucuugggcgugcuauugaug ugggacag (SEQ ID NO: 830) | | 12.372 | 115 |
| Tiling guide 30 flip 14 U | Gluc | RESCUE | UCG | U/30/14 | C82R | guucaucuugggcgugcuauuga ugugggac (SEQ ID NO: 831) | | 2.008 | 115 |
| Tiling guide 30 flip 12 U | Gluc | RESCUE | UCG | U/30/12 | C82R | gucuucaucuugggcgugcuauu gaugugggg (SEQ ID NO: 832) | | 4.807 | 115 |
| Tiling guide 30 flip 10 U | Gluc | RESCUE | UCG | U/30/10 | C82R | gcuucuucaucuugggcgugcua (SEQ ID NO: 833) | | 6.679 | 115 |
| Tiling guide 30 flip 8 U | Gluc | RESCUE | UCG | U/30/8 | C82R | gaacuucuucaucuugggcgugc uauugaug (SEQ ID NO: 834) | | 0.930 | 115 |
| Tiling guide 30 flip 6 U | Gluc | RESCUE | UCG | U/30/6 | C82R | gugaacuucuucaucuugggcgu gcuauuga (SEQ ID NO: 835) | | 22.763 | 115 |
| Tiling guide 30 flip 4 U | Gluc | RESCUE | UCG | U/30/4 | C82R | ggaugaacuucuucaucuugggc gugcuauu (SEQ ID NO: 836) | | 0.633 | 115 |
| Tiling guide 30 flip 2 U | Gluc | RESCUE | UCG | U/30/2 | C82R | ggggaugaacuucuucaucuugg gcgugcua (SEQ ID NO: 837) | | 0.266 | 115 |
| Tiling guide 50 | Gluc | RESCUE | UCG | U/50/50 | C82R | guauugaugugggacaggcagau | | 1.263 | 115 |

TABLE 29-continued

| Guide sequences used for luciferase editing | | | | | | | | | |
|---|---|---|---|---|---|---|---|---|---|
| Name | Targeted gene | REPAIR/ RESCUE | Motif | Base flip/ position | Codon change | Spacer sequence | Notes | Editing percentage (first figure) | First figure |
| flip 50 U | | | | | | cagacagccccuggugcagccag cuuuc (SEQ ID NO: 838) | | | |
| Tiling guide 50 flip 48 U | Gluc | RESCUE | UCG | U/50/48 | C82R | ggcuauugaugugggacaggcag aucagacagccccuggugcagcc agcuu (SEQ ID NO: 839) | | 24.879 | 115 |
| Tiling guide 50 flip 46 U | Gluc | RESCUE | UCG | U/50/46 | C82R | ggugcuauugaugugggacaggc agaucagacagccccuggugcag ccagc (SEQ ID NO: 840) | | 21.993 | 115 |
| Tiling guide 50 flip 44 U | Gluc | RESCUE | UCG | U/50/44 | C82R | ggcgugcuauugaugugggacag gcagaucagacagccccuggugc agcca (SEQ ID NO: 841) | | 25.736 | 115 |
| Tiling guide 50 flip 42 U | Gluc | RESCUE | UCG | U/50/42 | C82R | ggggcgugcuauugaugugggac aggcagaucagacagccccuggu gcagc (SEQ ID NO: 842) | | 27.579 | 115 |
| Tiling guide 50 flip 40 U | Gluc | RESCUE | UCG | U/50/40 | C82R | guugggcgugcuauugaugugggg acaggcagaucagacagccccug gugca (SEQ ID NO: 843) | | 27.775 | 115 |
| Tiling guide 50 flip 38 U | Gluc | RESCUE | UCG | U/50/38 | C82R | gucuugggcgugcuauugaugug ggacaggcagaucagacagcccc uggug (SEQ ID NO: 844) | | 13.260 | 115 |
| Tiling guide 50 flip 36 U | Gluc | RESCUE | UCG | U/50/36 | C82R | gcaucuugggcgugcuauugaug ugggacaggcagaucagacagcc ccugg (SEQ ID NO: 845) | | 9.892 | 115 |
| Tiling guide 50 flip 34 U | Gluc | RESCUE | UCG | U/50/34 | C82R | guucaucuugggcgugcuauuga ugugggacaggcagaucagacag ccccu (SEQ ID NO: 846) | | 19.186 | 115 |
| Tiling guide 50 flip 32 U | Gluc | RESCUE | UCG | U/50/32 | C82R | gucuucaucuugggcgugcuauu gaugugggacaggcagaucagac agccc (SEQ ID NO: 847) | | 22.932 | 115 |
| Tiling guide 50 flip 30 U | Gluc | RESCUE | UCG | U/50/30 | C82R | gcuucuucaucuugggcgugcua uugaugugggacaggcagaucag acagc (SEQ ID NO: 848) | | 12.794 | 115 |
| Tiling guide 50 flip 28 U | Gluc | RESCUE | UCG | U/50/28 | C82R | gaacuucuucaucuugggcgugc uauugaugugggacaggcagauc agaca (SEQ ID NO: 849) | | 33.367 | 115 |

TABLE 29-continued

| Guide sequences used for luciferase editing | | | | | | | | | |
|---|---|---|---|---|---|---|---|---|---|
| Name | Targeted gene | REPAIR/ RESCUE | Motif | Base flip/ position | Codon change | Spacer sequence | Notes | Editing percentage (first figure) | First figure |
| Tiling guide 50 flip 26 U | Gluc | RESCUE | UCG | U/50/26 | C82R | gugaacuucuucaucuugggcgugcuauugaugugggacaggcagaucaga (SEQ ID NO: 850) | | 32.651 | 115 |
| Tiling guide 50 flip 24 U | Gluc | RESCUE | UCG | U/50/24 | C82R | ggaugaacuucuucaucuugggcgugcuauugaugugggacaggcagauca (SEQ ID NO: 851) | | 22.201 | 115 |
| Tiling guide 50 flip 22 U | Gluc | RESCUE | UCG | U/50/22 | C82R | ggggaugaacuucuucaucuugggcgugcuauugaugugggacaggcagau (SEQ ID NO: 852) | | 12.607 | 115 |
| Tiling guide 50 flip 20 U | Gluc | RESCUE | UCG | U/50/20 | C82R | gcugggaugaacuucuucaucuugggcgugcuauugaugugggacaggcag (SEQ ID NO: 853) | | 17.727 | 115 |
| Tiling guide 50 flip 18 U | Gluc | RESCUE | UCG | U/50/18 | C82R | guccugggaugaacuucuucaucuugggcgugcuauugaugugggacaggc (SEQ ID NO: 854) | | 11.842 | 115 |
| Tiling guide 50 flip 16 U | Gluc | RESCUE | UCG | U/50/16 | C82R | gcguccugggaugaacuucuucaucuugggcgugcuauugaugugggacag (SEQ ID NO: 855) | | 9.368 | 115 |
| Tiling guide 50 flip 14 U | Gluc | RESCUE | UCG | U/50/14 | C82R | gagcguccugggaugaacuucuucaucuugggcgugcuauugaugugggac (SEQ ID NO: 856) | | 2.637 | 115 |
| Tiling guide 50 flip 12 U | Gluc | RESCUE | UCG | U/50/12 | C82R | ggcagcguccugggaugaacuucuucaucuugggcgugcuauugaugugg (SEQ ID NO: 857) | | 35.033 | 115 |
| Tiling guide 50 flip 10 U | Gluc | RESCUE | UCG | U/50/10 | C82R | guggcagcguccugggaugaacuucuucaucuugggcgugcuauugaugug (SEQ ID NO: 858) | | 10.675 | 115 |
| Tiling guide 50 flip 8 U | Gluc | RESCUE | UCG | U/50/8 | C82R | guguggcagcguccugggaugaacuucuucaucuugggcgugcuauugaug (SEQ ID NO: 859) | | 1.730 | 115 |
| Tiling guide 50 flip 6 U | Gluc | RESCUE | UCG | U/50/6 | C82R | gggugugg cagcguccugggaugaacuucuucaucuugggcgugcuauuga (SEQ ID NO: 860) | | 2.249 | 115 |
| Tiling guide 50 flip 4 U | Gluc | RESCUE | UCG | U/50/4 | C82R | guaggugugg cagcguccugggaugaacuucuucaucuugggcgugcuauu (SEQ ID NO: 861) | | 0.438 | 115 |

TABLE 29-continued

| Guide sequences used for luciferase editing | | | | | | | | | |
|---|---|---|---|---|---|---|---|---|---|
| Name | Targeted gene | REPAIR/ RESCUE | Motif | Base flip/ position | Codon change | Spacer sequence | Notes | Editing percentage (first figure) | First figure |
| Tiling guide 50 flip 2 U | Gluc | RESCUE | UCG | U/50/2 | C82R | gcguaggugugg cagcguccugg gaugaacuucuucaucuugggcg ugcua (SEQ ID NO: 862) | | 0.293 | 115 |
| Motif guide UCU, flip A | Gluc | RESCUE | UCU | A/30/26 | L82F | gugaAauugaugugggacaggca gaucaga (SEQ ID NO: 863) | | 0.084 | 114A-114C |
| Motif guide UCG, flip A | Gluc | RESCUE | UCG | A/30/26 | C82R | gugcAauugaugugggacaggca gaucaga (SEQ ID NO: 864) | | 0.399 | 114A-114C |
| Motif guide UCC, flip A | Gluc | RESCUE | UCC | A/30/26 | P82S | guggAauugaugugggacaggca gaucaga (SEQ ID NO: 865) | | 0.210 | 114A-114C |
| Motif guide UCA, flip A | Gluc | RESCUE | UCA | A/30/26 | H82Y | guguAauugaugugggacaggca gaucaga (SEQ ID NO: 866) | | 0.077 | 114A-114C |
| Motif guide ACU, flip A | Gluc | RESCUE | ACU | A/30/26 | L82F | gugaAuuugaugugggacaggca gaucaga (SEQ ID NO: 867) | | 0.097 | 114A-114C |
| Motif guide ACG, flip A | Gluc | RESCUE | ACG | A/30/26 | C82R | gugcAuuugaugugggacaggca gaucaga (SEQ ID NO: 868) | | 0.399 | 114A-114C |
| Motif guide ACC, flip A | Gluc | RESCUE | ACC | A/30/26 | P82S | guggAuuugaugugggacaggca gaucaga (SEQ ID NO: 869) | | 0.138 | 114A-114C |
| Motif guide ACA, flip A | Gluc | RESCUE | ACA | A/30/26 | H82Y | guguAuuugaugugggacaggca gaucaga (SEQ ID NO: 870) | | 0.036 | 114A-114C |
| Motif guide GCU, flip A | Gluc | RESCUE | GCU | A/30/26 | L82F | gugaAcuugaugugggacaggca gaucaga (SEQ ID NO: 871) | | 0.057 | 114A-114C |
| Motif guide GCG, flip A | Gluc | RESCUE | GCG | A/30/26 | C82R | gugcAcuugaugugggacaggca gaucaga (SEQ ID NO: 872) | | 0.029 | 114A-114C |
| Motif guide GCC, flip A | Gluc | RESCUE | GCC | A/30/26 | P82S | guggAcuugaugugggacaggca gaucaga (SEQ ID NO: 873) | | 0.023 | 114A-114C |
| Motif guide GCA, flip A | Gluc | RESCUE | GCA | A/30/26 | H82Y | guguAcuugaugugggacaggca gaucaga (SEQ ID NO: 874) | | 0.022 | 114A-114C |
| Motif guide CCU, flip A | Gluc | RESCUE | CCU | A/30/26 | L82F | gugaAguugaugugggacaggca gaucaga (SEQ ID NO: 875) | | 0.055 | 114A-114C |
| Motif guide CCG, flip A | Gluc | RESCUE | CCG | A/30/26 | C82R | gugcAguugaugugggacaggca gaucaga (SEQ ID NO: 876) | | 0.066 | 114A-114C |

TABLE 29-continued

Guide sequences used for luciferase editing

| Name | Targeted gene | REPAIR/ RESCUE | Motif | Base flip/ position | Codon change | Spacer sequence | Notes | Editing percentage (first figure) | First figure |
|---|---|---|---|---|---|---|---|---|---|
| Motif guide CCC, flip A | Gluc | RESCUE | CCC | A/30/26 | P82S | guggAguugaugugggacaggca gaucaga (SEQ ID NO: 877) | | 0.016 | 114A-114C |
| Motif guide CCA, flip A | Gluc | RESCUE | CCA | A/30/26 | H82Y | guguAguugaugugggacaggca gaucaga (SEQ ID NO: 878) | | 0.022 | 114A-114C |
| Motif guide UCU, flip G | Gluc | RESCUE | UCU | G/30/26 | L82F | gugaGauugaugugggacaggca gaucaga (SEQ ID NO: 879) | | 0.058 | 114A-114C |
| Motif guide UCG, flip G | Gluc | RESCUE | UCG | G/30/26 | C82R | gugcGauugaugugggacaggca gaucaga (SEQ ID NO: 880) | | 0.094 | 114A-114C |
| Motif guide UCC, flip G | Gluc | RESCUE | UCC | G/30/26 | P82S | guggGauugaugugggacaggca gaucaga (SEQ ID NO: 881) | | 0.022 | 114A-114C |
| Motif guide UCA, flip G | Gluc | RESCUE | UCA | G/30/26 | H82Y | guguGauugaugugggacaggca gaucaga (SEQ ID NO: 882) | | 0.026 | 114A-114C |
| Motif guide ACU, flip G | Gluc | RESCUE | ACU | G/30/26 | L82F | gugaGuuugaugugggacaggca gaucaga (SEQ ID NO: 883) | | 0.053 | 114A-114C |
| Motif guide ACG, flip G | Gluc | RESCUE | ACG | G/30/26 | C82R | gugcGuuugaugugggacaggca gaucaga (SEQ ID NO: 884) | | 0.035 | 114A-114C |
| Motif guide ACC, flip G | Gluc | RESCUE | ACC | G/30/26 | P82S | guggGuuugaugugggacaggca gaucaga (SEQ ID NO: 885) | | 0.017 | 114A-114C |
| Motif guide ACA, flip G | Gluc | RESCUE | ACA | G/30/26 | H82Y | guguGuuugaugugggacaggca gaucaga (SEQ ID NO: 886) | | 0.030 | 114A-114C |
| Motif guide GCU, flip G | Gluc | RESCUE | GCU | G/30/26 | L82F | gugaGcuugaugugggacaggca gaucaga (SEQ ID NO: 887) | | 0.053 | 114A-114C |
| Motif guide GCG, flip G | Gluc | RESCUE | GCG | G/30/26 | C82R | gugcGcuugaugugggacaggca gaucaga (SEQ ID NO: 888) | | 0.026 | 114A-114C |
| Motif guide GCC, flip G | Gluc | RESCUE | GCC | G/30/26 | P82S | guggGcuugaugugggacaggca gaucaga (SEQ ID NO: 889) | | 0.018 | 114A-114C |
| Motif guide GCA, flip G | Gluc | RESCUE | GCA | G/30/26 | H82Y | guguGcuugaugugggacaggca gaucaga (SEQ ID NO: 890) | | 0.018 | 114A-114C |
| Motif guide CCU, flip G | Gluc | RESCUE | CCU | G/30/26 | L82F | gugaGguugaugugggacaggca gaucaga (SEQ ID NO: 891) | | 0.049 | 114A-114C |
| Motif guide CCG, flip G | Gluc | RESCUE | CCG | G/30/26 | C82R | gugcGguugaugugggacaggca gaucaga (SEQ ID NO: 892) | | 0.064 | 114A-114C |

TABLE 29-continued

| Name | Targeted gene | REPAIR/ RESCUE | Motif | Base flip/ position | Codon change | Spacer sequence | Notes | Editing percentage (first figure) | First figure |
|---|---|---|---|---|---|---|---|---|---|
| Guide sequences used for luciferase editing | | | | | | | | | |
| Motif guide CCC, flip G | Gluc | RESCUE | CCC | G/30/26 | P82S | guggGguugaugugggacaggca gaucaga (SEQ ID NO: 893) | | 0.011 | 114A-114C |
| Motif guide CCA, flip G | Gluc | RESCUE | CCA | G/30/26 | H82Y | guguGguugaugugggacaggca gaucaga (SEQ ID NO: 894) | | 0.017 | 114A-114C |
| Tiling guide 30 flip 30 C | Gluc | RESCUE | UCG | C/30/30 | C82R | guguugaugugggacaggcagau cagacagc (SEQ ID NO: 895) | | 0.164 | 122A-12224C |
| Tiling guide 30 flip 28 C | Gluc | RESCUE | UCG | C/30/28 | C82R | ggcuguugaugugggacaggcag aucagaca (SEQ ID NO: 896) | | 37.368 | 122A-122C |
| Tiling guide 30 flip 26 C | Gluc | RESCUE | UCG | C/30/26 | C82R | ggugcuguugaugugggacaggc agaucaga (SEQ ID NO: 897) | | 44.775 | 122A-122C |
| Tiling guide 30 flip 24 C | Gluc | RESCUE | UCG | C/30/24 | C82R | ggcgugcuguugaugugggacag gcagauca (SEQ ID NO: 898) | | 26.988 | 122A-122C |
| Tiling guide 30 flip 22 C | Gluc | RESCUE | UCG | C/30/22 | C82R | ggggcgugcuguugaugugggac aggcagau (SEQ ID NO: 899) | | 16.710 | 122A-122C |
| Tiling guide 30 flip 20 C | Gluc | RESCUE | UCG | C/30/20 | C82R | guugggcgugcuguugaugugggg acaggcag (SEQ ID NO: 900) | | 29.288 | 122A-122C |
| Tiling guide 30 flip 18 C | Gluc | RESCUE | UCG | C/30/18 | C82R | gucuugggcgugcuguugaugug ggacaggc (SEQ ID NO: 901) | | 18.125 | 122A-122C |
| Tiling guide 30 flip 16 C | Gluc | RESCUE | UCG | C/30/16 | C82R | gcaucuugggcgugcuguugaug ugggacag (SEQ ID NO: 902) | | 1.532 | 122A-122C |
| Tiling guide 30 flip 14 C | Gluc | RESCUE | UCG | C/30/14 | C82R | guucaucuugggcgugcuguuga ugugggac (SEQ ID NO: 903) | | 0.184 | 122A-122C |
| Tiling guide 30 flip 12 C | Gluc | RESCUE | UCG | C/30/12 | C82R | gucuucaucuugggcgugcuguu gaugugggg (SEQ ID NO: 904) | | 0.341 | 122A-122C |
| Tiling guide 30 flip 10 C | Gluc | RESCUE | UCG | C/30/10 | C82R | gcuucuucaucuugggcgugcug uugaugug (SEQ ID NO: 905) | | 0.275 | 122A-122C |
| Tiling guide 30 flip 8 C | Gluc | RESCUE | UCG | C/30/8 | C82R | gaacuucuucaucuugggcgugc uguugaug (SEQ ID NO: 906) | | 0.054 | 122A-122C |
| Tiling guide 30 flip 6 C | Gluc | RESCUE | UCG | C/30/6 | C82R | gugaacuucuucaucuugggcgu gcuguuga (SEQ ID NO: 907) | | 0.437 | 122A-122C |
| Tiling guide 30 | Gluc | RESCUE | UCG | C/30/4 | C82R | ggaugaacuucuucaucuugggc | | 0.226 | 122A-122C |

TABLE 29-continued

| Guide sequences used for luciferase editing | | | | | | | | | |
|---|---|---|---|---|---|---|---|---|---|
| Name | Targeted gene | REPAIR/ RESCUE | Motif | Base flip/ position | Codon change | Spacer sequence | Notes | Editing percentage (first figure) | First figure |
| flip 4 C | | | | | | gugcuguu (SEQ ID NO: 908) | | | |
| Tiling guide 30 flip 2 C | Gluc | RESCUE | UCG | C/30/2 | C82R | ggggaugaacuucuucaucuugg gcgugcug (SEQ ID NO: 909) | | 0.040 | 122A-122C |

TABLE 30

Guide sequences used for endogenous gene editing

| Name | Target-ed gene | REPAIR/ RESCUE | Motif | Base flip/ posi-tion | Codon change | Spacer sequence | Editing percent-age (first figure) | First fig-ure |
|---|---|---|---|---|---|---|---|---|
| S33F_CTNNB1_30bp_guide_30_9 C flip | CTNNB1 | RESCUE | UCU | C/22 | S33F | GGGAUUCCACAGUCCAGGU AAGACUGUUGCU (SEQ ID NO: 910) | 11.245 | 103E |
| H36Y_CTNNB1_30bp_guide_30_9 U flip | CTNNB1 | RESCUE | CCA | U/22 | H36Y | GACCAGAAUUGAUUCCAGA GUCCAGGUAAGA (SEQ ID NO: 911) | 2.995 | 103E |
| S37F_CTNNB1_30bp_guide_30_9 U flip | CTNNB1 | RESCUE | UCU | U/22 | S37F | GUGGCACCAUAAUGGAUUC CAGAGUCCAGGU (SEQ ID NO: 912) | 17.616 | 103E |
| T41I_CTNNB1_30bp_guide_30_11 U flip | CTNNB1 | RESCUE | ACC | U/20 | T41I | GAGGAGCUGUGUUAGUGGC ACCAGAAUGGAU (SEQ ID NO: 913) | 15.711 | 103E |
| P44L_CTNNB1_30bp_guide_30_9 C flip | CTNNB1 | RESCUE | CCU | C/22 | P44L | GUCAGAGAACGAGCUGUGG UAGUGGCACCAG (SEQ ID NO: 914) | 8.599 | 103E |
| P44S_CTNNB1_30bp_guide_30_11 U flip | CTNNB1 | RESCUE | UCU | U/20 | P44S | GCUCAGAGAAGUAGCUGUG GUAGUGGCACCA (SEQ ID NO: 915) | 22.839 | 103E |
| S45F_CTNNB1_30bp_guide_30_11 C flip | CTNNB1 | RESCUE | UCU | C/20 | S45F | GACCACUCAGACAAGGAGC UGUGGUAGUGGC (SEQ ID NO: 916) | 12.412 | 103E |
| TCG_KRAS_30bp_guide_30_7 U flip | KRAS | RESCUE | UCG | U/24 | L56L | GUGUGUCUAGAAUAUCCAA GAGACAGGUUUC (SEQ ID NO: 917) | 18.405 | 103E |
| ACG_KRAS_30bp_guide_30_11 C flip | KRAS | RESCUE | ACG | C/20 | D30D | GGAUCAUAUUCCUCCACAA AAUGAUUCUGAA (SEQ ID NO: 918) | 34.013 | 103E |
| GCG_KRAS_30bp_guide_30_11 U flip | KRAS | RESCUE | GCG | U/20 | G13G | GUCUUGCCUACUCCACCAG CUCCAACUACCA (SEQ ID NO: 919) | 2.180 | 103E |
| CCT_KRAS_30bp_guide_30_11 C flip | KRAS | RESCUE | CCU | C/20 | A18A | GGUAUCGUCAACGCACUCU UGCCUACGCCAC (SEQ ID NO: 920) | 9.465 | 103E |
| TCG_PPIB_30bp_guide_30_11 U flip | PPIB | RESCUE | UCG | U/20 | I18I | GCGGACCCCGCUAUGAGGG CGGCGGCAAGGA (SEQ ID NO: 921) | 10.340 | 103E |
| ACG_PPIB_30bp_guide_30_7 C flip | PPIB | RESCUE | ACG | C/24 | R7C | GAUAUUCCUCCACAAAAUG AUUCUGAAUUAG (SEQ ID NO: 922) | 34.213 | 103E |
| GCG_PPIB_30bp_guide_30_11 U flip | PPIB | RESCUE | GCG | U/20 | A19V | GGACGGACCCCUCGAUGAG GGCGGCGGCAAG (SEQ ID NO: 923) | 4.778 | 103E |
| CCG_PPIB_30bp_guide_30_11 C flip | PPIB | RESCUE | CCG | C/20 | S21S | GGGAAGAAGACCGACCCCG CGAUGAGGGCGG (SEQ ID NO: 924) | 6.101 | 103E |
| TCG_SMARCA4_30bp_guide_30_9 U flip | SMARCA4 | RESCUE | UCG | U/22 | S85L | GGGUCGUCCUACAUGCCCU UCUCAUGCAUGG (SEQ ID NO: 925) | 6.807 | 103E |
| ACG_SMARCA4_30bp_guide_30_11 U flip | SMARCA4 | RESCUE | ACG | U/20 | D86D | GAGCGCGGGUCUUCCGACA UGCCCUUCUCAU (SEQ ID NO: 926) | 6.943 | 103E |
| GCG_SMARCA4_30bp_guide_30_11 C flip | SMARCA4 | RESCUE | GCG | C/20 | R89C | GUGGUUGUAGCCCGGGUCG UCCGACAUGCCC (SEQ ID NO: 927) | 2.277 | 103E |

TABLE 30-continued

Guide sequences used for endogenous gene editing

| Name | Target-ed gene | REPAIR/RESCUE | Motif | Base flip/position | Codon change | Spacer sequence | Editing percent-age (first figure) | First fig-ure |
|---|---|---|---|---|---|---|---|---|
| CCG_SMARCA4_30bp_guide_30_11 U flip | SMARCA4 | RESCUE | CCG | U/20 | P88L | GGUUGUAGCGCUGGUCGUC CGACAUGCCCUU (SEQ ID NO: 928) | 4.819 | 103E |
| NRAS_C-flip_guide_30_11 | NRAS | RESCUE | UCC | C/20 | I21I | GGGAUUAGCUGCAUUGUCA GUGCGCUUUUCC (SEQ ID NO: 929) | 21.529 | 103E |
| NKFB1_U-flip_guide_30_11 | NFKB | RESCUE | ACC | U/20 | P33S | GGCCAUCUGUGUUUGAAAU ACUUCUGGAUUA (SEQ ID NO: 930) | 24.376 | 103E |
| EZH2_U-flip_guide_30_11 | EZH2 | RESCUE | UCA | U/20 | F32F | GCAGCUCGUCUUAACCUCU UGAGCUGUCUCA (SEQ ID NO: 931) | 15.855 | 103E |
| NF2_U-flip_guide_30_7 | NF2 | RESCUE | ACG | U/24 | T21M | GGUGAACUUCUUGGGUUGC UUCCUCUUGAGA (SEQ ID NO: 932) | 24.904 | 103E |
| RAF1_U-flip_guide_30_7 | RAF1 | RESCUE | UCC | U/24 | P30S | GUUGUAGUAGAGAUGCAGC UGGAGCCAUCAA (SEQ ID NO: 933) | 20.867 | 103E |
| S33F_CTNNB1_30bp_guide_U-flip_30_7 | CTNNB1 | RESCUE | UCU | U/24 | S33F | GAUUCCAUAGUCCAGGUAA GACUGUUGCUGC (SEQ ID NO: 934) | 9.227 | 125A |
| S33F_CTNNB1_30bp_guide_U-flip_30_9 | CTNNB1 | RESCUE | UCU | U/22 | S33F | GGGAUUCCAUAGUCCAGGU AAGACUGUUGCU (SEQ ID NO: 935) | 11.245 | 125A |
| S33F_CTNNB1_30bp_guide_U-flip_30_11 | CTNNB1 | RESCUE | UCU | U/20 | S33F | GAUGGAUUCCAUAGUCCAG GUAAGACUGUUG (SEQ ID NO: 936) | 7.081 | 125A |
| S33F_CTNNB1_30bp_guide_U-flip_30_13 | CTNNB1 | RESCUE | UCU | U/18 | S33F | GGAAUGGAUUCCAUAGUCC AGGUAAGACUGU (SEQ ID NO: 937) | 9.782 | 125A |
| H36Y_CTNNB1_30bp_guide_U-flip_30_7 | CTNNB1 | RESCUE | CCA | U/24 | H36Y | GCAGAAUUGAUUCCAGAGU CCAGGUAAGACU (SEQ ID NO: 938) | 1.310 | 125A |
| H36Y_CTNNB1_30bp_guide_U-flip_30_9 | CTNNB1 | RESCUE | CCA | U/22 | H36Y | GACCAGAAUUGAUUCCAGA GUCCAGGUAAGA (SEQ ID NO: 939) | 2.995 | 125A |
| H36Y_CTNNB1_30bp_guide_U-flip_30_11 | CTNNB1 | RESCUE | CCA | U/20 | H36Y | GGCACCAGAAUUGAUUCCA GAGUCCAGGUAA (SEQ ID NO: 940) | 0.918 | 125A |
| H36Y_CTNNB1_30bp_guide_U-flip_30_13 | CTNNB1 | RESCUE | CCA | U/18 | H36Y | GUGGCACCAGAAUUGAUUC CAGAGUCCAGGU (SEQ ID NO: 941) | 1.061 | 125A |
| S37F CTNNB1_30bp_guide_U-flip_30_7 | CTNNB1 | RESCUE | UCU | U/24 | S37F | GGCACCAUAAUGGAUUCCA GAGUCCAGGUAA (SEQ ID NO: 942) | 17.616 | 125A |
| S37F_CTNNB1_30bp_guide_U-flip_30_9 | CTNNB1 | RESCUE | UCU | U/22 | S37F | GUGGCACCAUAAUGGAUUC CAGAGUCCAGGU (SEQ ID NO: 943) | 10.901 | 125A |
| S37F_CTNNB1_30bp_guide_U-flip_30_11 | CTNNB1 | RESCUE | UCU | U/20 | S37F | GAGUGGCACCAUAAUGGAU UCCAGAGUCCAG (SEQ ID NO: 944) | 8.898 | 125A |
| S37F_CTNNB1_30bp_guide_U-flip_30_13 | CTNNB1 | RESCUE | UCU | U/18 | S37F | GGUAGUGGCACCAUAAUGG AUUCCAGAGUCC (SEQ ID NO: 945) | 11.718 | 125A |

TABLE 30-continued

Guide sequences used for endogenous gene editing

| Name | Target-ed gene | REPAIR/ RESCUE | Motif | Base flip/ posi-tion | Codon change | Spacer sequence | Editing percent-age (first figure) | First fig-ure |
|---|---|---|---|---|---|---|---|---|
| T41I_CTNNB1_30bp_guide_U-flip_30_7 | CTNNB1 | RESCUE | ACC | U/24 | T41I | GGCUGUGUUAGUGGCACCA GAAUGGAUUCCA (SEQ ID NO: 946) | 4.936 | 125A |
| T41I_CTNNB1_30bp_guide_U-flip_30_9 | CTNNB1 | RESCUE | ACC | U/22 | T41I | GGAGCUGUGUUAGUGGCAC CAGAAUGGAUUC (SEQ ID NO: 947) | 14.554 | 125A |
| T41I_CTNNB1_30bp_guide_U-flip_30_11 | CTNNB1 | RESCUE | ACC | U/20 | T41I | GAGGAGCUGUGUUAGUGGC ACCAGAAUGGAU (SEQ ID NO: 948) | 14.890 | 125A |
| T41I_CTNNB1_30bp_guide_U-flip_30_13 | CTNNB1 | RESCUE | ACC | U/18 | T41I | GGAAGGAGCUGUGUUAGUG GCACCAGAAUGG (SEQ ID NO: 949) | 15.711 | 125A |
| P44L_CTNNB1_30bp_guide_U-flip_30_7 | CTNNB1 | RESCUE | CCU | U/24 | P44L | GAGAGAAUGAGCUGUGGUA GUGGCACCAGAA (SEQ ID NO: 950) | 3.767 | 125A |
| P44L_CTNNB1_30bp_guide_U-flip_30_9 | CTNNB1 | RESCUE | CCU | U/22 | P44L | GUCAGAGAAUGAGCUGUGG UAGUGGCACCAG (SEQ ID NO: 951) | 6.569 | 125A |
| P44L_CTNNB1_30bp_guide_U-flip_30_11 | CTNNB1 | RESCUE | CCU | U/20 | P44L | GACUCAGAGAAUGAGCUGU GGUAGUGGCACC (SEQ ID NO: 952) | 8.599 | 125A |
| P44L_CTNNB1_30bp_guide_U-flip_30_13 | CTNNB1 | RESCUE | CCU | U/18 | P44L | GCCACUCAGAGAAUGAGCU GUGGUAGUGGCA (SEQ ID NO: 953) | 2.435 | 125A |
| P44S_CTNNB1_30bp_guide_U-flip_30_7 | CTNNB1 | RESCUE | UCU | U/24 | P44S | GGAGAAGUAGCUGUGGUAG UGGCACCAGAAU (SEQ ID NO: 954) | 16.371 | 125A |
| P44S_CTNNB1_30bp_guide_U-flip_30_9 | CTNNB1 | RESCUE | UCU | U/22 | P44S | GCAGAGAAGUAGCUGUGGU AGUGGCACCAGA (SEQ ID NO: 955) | 22.090 | 125A |
| P44S_CTNNB1_30bp_guide_U-flip_30_11 | CTNNB1 | RESCUE | UCU | U/20 | P44S | GCUCAGAGAAGUAGCUGUG GUAGUGGCACCA (SEQ ID NO: 956) | 22.839 | 125A |
| P44S_CTNNB1_30bp_guide_U-flip_30_13 | CTNNB1 | RESCUE | UCU | U/18 | P44S | GCACUCAGAGAAGUAGCUG UGGUAGUGGCAC (SEQ ID NO: 957) | 15.900 | 125A |
| S45F_CTNNB1_30bp_guide_U-flip_30_7 | CTNNB1 | RESCUE | UCU | U/24 | S45F | GCUCAGAUAAGGAGCUGUG GUAGUGGCACCA (SEQ ID NO: 958) | 7.049 | 125A |
| S45F_CTNNB1_30bp_guide_U-flip_30_9 | CTNNB1 | RESCUE | UCU | U/22 | S45F | GCACUCAGAUAAGGAGCUG UGGUAGUGGCAC (SEQ ID NO: 959) | 9.828 | 125A |
| S45F_CTNNB1_30bp_guide_U-flip_30_11 | CTNNB1 | RESCUE | UCU | U/20 | S45F | GACCACUCAGAUAAGGAGC UGUGGUAGUGGC (SEQ ID NO: 960) | 12.412 | 125A |
| S45F_CTNNB1_30bp_guide_U-flip_30_13 | CTNNB1 | RESCUE | UCU | U/18 | S45F | GUUACCACUCAGAUAAGGA GCUGUGGUAGUG (SEQ ID NO: 961) | 9.093 | 125A |
| TCG_KRAS_30bp_guide_U-flip_30_7 | KRAS | RESCUE | UCG | U/24 | L56L | GUGUGUCUAGAAUAUCCAA GAGACAGGUUUC (SEQ ID NO: 962) | 18.707 | 125A |
| TCG_KRAS_30bp_guide_U-flip_30_9 | KRAS | RESCUE | UCG | U/22 | L56L | GGCUGUGUCUAGAAUAUCC AAGAGACAGGUU (SEQ ID NO: 963) | 18.405 | 125A |

TABLE 30-continued

Guide sequences used for endogenous gene editing

| Name | Targeted gene | REPAIR/RESCUE | Motif | Base flip/position | Codon change | Spacer sequence | Editing percentage (first figure) | First figure |
|---|---|---|---|---|---|---|---|---|
| TCG_KRAS_30bp_guide_U-flip_30_11 | KRAS | RESCUE | UCG | U/20 | L56L | GCUGCUGUGUCUAGAAUAUCCAAGAGACAGG (SEQ ID NO: 964) | 15.533 | 125A |
| TCG_KRAS_30bp_guide_U-flip_30_13 | KRAS | RESCUE | UCG | U/18 | L56L | GACCUGCUGUGUCUAGAAUAUCCAAGAGACA (SEQ ID NO: 965) | 15.119 | 125A |
| ACG_KRAS_30bp_guide_U-flip_30_7 | KRAS | RESCUE | ACG | U/24 | D30D | GAUAUUCUUCCACAAAAUGAUUCUGAAUUAG (SEQ ID NO: 966) | 21.288 | 125A |
| ACG_KRAS_30bp_guide_U-flip_30_9 | KRAS | RESCUE | ACG | U/22 | D30D | GUCAUAUUCUUCCACAAAAUGAUUCUGAAUU (SEQ ID NO: 967) | 24.011 | 125A |
| ACG_KRAS_30bp_guide_U-flip_30_11 | KRAS | RESCUE | ACG | U/20 | D30D | GGAUCAUAUUCUUCCACAAAAUGAUUCUGAA (SEQ ID NO: 968) | 34.013 | 125A |
| ACG_KRAS_30bp_guide_U-flip_30_13 | KRAS | RESCUE | ACG | U/18 | D30D | GUGGAUCAUAUUCUUCCACAAAAUGAUUCUG (SEQ ID NO: 969) | 22.047 | 125A |
| GCG_KRAS_30bp_guide_U-flip_30_7 | KRAS | RESCUE | GCG | U/24 | G13G | GGCCUACUCCACCAGCUCCAACUACCACAAG (SEQ ID NO: 970) | 0.476 | 125A |
| GCG_KRAS_30bp_guide_U-flip_30_9 | KRAS | RESCUE | GCG | U/22 | G13G | GUUGCCUACUCCACCAGCUCCAACUACCACA (SEQ ID NO: 971) | 1.735 | 125A |
| GCG_KRAS_30bp_guide_U-flip_30_11 | KRAS | RESCUE | GCG | U/20 | G13G | GUCUUGCCUACUCCACCAGCUCCAACUACCA (SEQ ID NO: 972) | 2.180 | 125A |
| GCG_KRAS_30bp_guide_U-flip_30_13 | KRAS | RESCUE | GCG | U/18 | G13G | GACUCUUGCCUACUCCACCAGCUCCAACUA (SEQ ID NO: 973) | 0.559 | 125A |
| CCT_KRAS_30bp_guide_U-flip_30_7 | KRAS | RESCUE | CCU | U/24 | A18A | GCGUCAAUGCACUCUUGCCUACGCCACCAGC (SEQ ID NO: 974) | 1.694 | 125A |
| CCT_KRAS_30bp_guide_U-flip_30_9 | KRAS | RESCUE | CCU | U/22 | A18A | GAUCGUCAAUGCACUCUUGCCUACGCCACCA (SEQ ID NO: 975) | 6.043 | 125A |
| CCT_KRAS_30bp_guide_U-flip_30_11 | KRAS | RESCUE | CCU | U/20 | A18A | GGUAUCGUCAAUGCACUCUUGCCUACGCCAC (SEQ ID NO: 976) | 9.465 | 125A |
| CCT_KRAS_30bp_guide_U-flip_30_13 | KRAS | RESCUE | CCU | U/18 | A18A | GCUGUAUCGUCAAUGCACUCUUGCCUACGCC (SEQ ID NO: 977) | 3.147 | 125A |
| TCG_PPIB_30bp_guide_U-flip_30_7 | PPIB | RESCUE | UCG | U/24 | I18I | GCCCCGCUAUGAGGGCGGCGGCAAGGAGCAC (SEQ ID NO: 978) | 5.536 | 125A |
| TCG_PPIB_30bp_guide_U-flip_30_9 | PPIB | RESCUE | UCG | U/22 | I18I | GGACCCCGCUAUGAGGGCGGCGGCAAGGAGC (SEQ ID NO: 979) | 8.914 | 125A |
| TCG_PPIB_30bp_guide_U-flip_30_11 | PPIB | RESCUE | UCG | U/20 | I18I | GCGGACCCCGCUAUGAGGGCGGCGGCAAGGA (SEQ ID NO: 980) | 10.340 | 125A |
| TCG_PPIB_30bp_guide_U-flip_30_13 | PPIB | RESCUE | UCG | U/18 | I18I | GGACGGACCCCGCUAUGAGGGCGGCGGCAAG (SEQ ID NO: 981) | 8.663 | 125A |

TABLE 30-continued

| Guide sequences used for endogenous gene editing | | | | | | | | |
|---|---|---|---|---|---|---|---|---|
| Name | Target-ed gene | REPAIR/RESCUE | Motif | Base flip/posi-tion | Codon change | Spacer sequence | Editing percent-age (first figure) | First fig-ure |
| ACG_PPIB_30bp_guide_U-flip_30_7 | PPIB | RESCUE | ACG | U/24 | R7C | GUGUUGCUUUCGGAGAGGC GCAGCAUCCACA (SEQ ID NO: 982) | 34.213 | 125A |
| ACG_PPIB_30bp_guide_U-flip_30_9 | PPIB | RESCUE | ACG | U/22 | R7C | GCAUGUUGCUUUCGGAGAG GCGCAGCAUCCA (SEQ ID NO: 983) | 31.652 | 125A |
| ACG_PPIB_30bp_guide_U-flip_30_11 | PPIB | RESCUE | ACG | U/20 | R7C | GUUCAUGUUGCUUUCGGAG AGGCGCAGCAUC (SEQ ID NO: 984) | 26.969 | 125A |
| ACG_PPIB_30bp_guide_U-flip_30_13 | PPIB | RESCUE | ACG | U/18 | R7C | GCCUUCAUGUUGCUUUCGG AGAGGCGCAGCA (SEQ ID NO: 985) | 22.539 | 125A |
| GCG_PPIB_30bp_guide_U-flip_30_7 | PPIB | RESCUE | GCG | U/24 | A19V | GGACCCCUCGAUGAGGGCG GCGGCAAGGAGC (SEQ ID NO: 986) | 1.030 | 125A |
| GCG_PPIB_30bp_guide_U-flip_30_9 | PPIB | RESCUE | GCG | U/22 | A19V | GCGGACCCCUCGAUGAGGG CGGCGGCAAGGA (SEQ ID NO: 987) | 4.819 | 125A |
| GCG_PPIB_30bp_guide_U-flip_30_11 | PPIB | RESCUE | GCG | U/20 | A19V | GGACGGACCCCUCGAUGAG GGCGGCGGCAAG (SEQ ID NO: 988) | 4.778 | 125A |
| GCG_PPIB_30bp_guide_U-flip_30_13 | PPIB | RESCUE | GCG | U/18 | A19V | GAAGACGGACCCCUCGAUG AGGGCGGCGGCA (SEQ ID NO: 989) | 1.115 | 125A |
| CCG_PPIB_30bp_guide_U-flip_30_7 | PPIB | RESCUE | CCG | U/24 | S21S | GGAAGACUGACCCCGCGAU GAGGGCGGCGGC (SEQ ID NO: 990) | 3.150 | 125A |
| CCG_PPIB_30bp_guide_U-flip_30_9 | PPIB | RESCUE | CCG | U/22 | S21S | GAAGAAGACUGACCCCGCG AUGAGGGCGGCG (SEQ ID NO: 991) | 2.659 | 125A |
| CCG_PPIB_30bp_guide_U-flip_30_11 | PPIB | RESCUE | CCG | U/20 | S21S | GGGAAGAAGACUGACCCCG CGAUGAGGGCGG (SEQ ID NO: 992) | 6.101 | 125A |
| CCG_PPIB_30bp_guide_U-flip_30_13 | PPIB | RESCUE | CCG | U/18 | S21S | GCAGGAAGAAGACUGACCC CGCGAUGAGGGC (SEQ ID NO: 993) | 4.372 | 125A |
| TCG_SMARCA4_30bp_guide_U-flip_30_7 | SMARCA4 | RESCUE | UCG | U/24 | S85L | GUCGUCCUACAUGCCCUUC UCAUGCAUGGAC (SEQ ID NO: 994) | 5.692 | 125A |
| TCG_SMARCA4_30bp_guide_U-flip_30_9 | SMARCA4 | RESCUE | UCG | U/22 | S85L | GGGUCGUCCUACAUGCCCU UCUCAUGCAUGG (SEQ ID NO: 995) | 6.807 | 125A |
| TCG_SMARCA4_30bp_guide_U-flip_30_11 | SMARCA4 | RESCUE | UCG | U/20 | S85L | GCGGGUCGUCCUACAUGCC CUUCUCAUGCAU (SEQ ID NO: 996) | 3.724 | 125A |
| TCG_SMARCA4_30bp_guide_U-flip_30_13 | SMARCA4 | RESCUE | UCG | U/18 | S85L | GCGCGGGUCGUCCUACAUG CCCUUCUCAUGC (SEQ ID NO: 997) | 2.274 | 125A |
| ACG_SMARCA4_30bp_guide_U-flip_30_7 | SMARCA4 | RESCUE | ACG | U/24 | D86D | GCGGGUCUUCCGACAUGCC CUUCUCAUGCAU (SEQ ID NO: 998) | 3.689 | 125A |
| ACG_SMARCA4_30bp_guide_U-flip_30_9 | SMARCA4 | RESCUE | ACG | U/22 | D86D | GCGCGGGUCUUCCGACAUG CCCUUCUCAUGC (SEQ ID NO: 999) | 4.868 | 125A |

TABLE 30-continued

| Name | Target-ed gene | REPAIR/ RESCUE | Motif | Base flip/ posi-tion | Codon change | Spacer sequence | Editing percent-age (first figure) | First fig-ure |
|---|---|---|---|---|---|---|---|---|
| Guide sequences used for endogenous gene editing | | | | | | | | |
| ACG_SMARCA4_30bp_guide_U-flip_30_11 | SMARCA4 | RESCUE | ACG | U/20 | D86D | GAGCGCGGGUCUUCCGACA UGCCCUUCUCAU (SEQ ID NO: 1000) | 6.943 | 125A |
| ACG_SMARCA4_30bp_guide_U-flip_30_13 | SMARCA4 | RESCUE | ACG | U/18 | D86D | GGUAGCGCGGGUCUUCCGA CAUGCCCUUCUC (SEQ ID NO: 1001) | 5.785 | 125A |
| GCG_SMARCA4_30bp_guide_U-flip_30_7 | SMARCA4 | RESCUE | GCG | U/24 | R89C | GUGUAGCUCGGGUCGUCCG ACAUGCCCUUCU (SEQ ID NO: 1002) | 0.642 | 125A |
| GCG_SMARCA4_30bp_guide_U-flip_30_9 | SMARCA4 | RESCUE | GCG | U/22 | R89C | GGUUGUAGCUCGGGUCGUC CGACAUGCCCUU (SEQ ID NO: 1003) | 1.808 | 125A |
| GCG_SMARCA4_30bp_guide_U-flip_30_11 | SMARCA4 | RESCUE | GCG | U/20 | R89C | GUGGUUGUAGCUCGGGUCG UCCGACAUGCCC (SEQ ID NO: 1004) | 2.277 | 125A |
| GCG_SMARCA4_30bp_guide_U-flip_30_13 | SMARCA4 | RESCUE | GCG | U/18 | R89C | GUCUGGUUGUAGCUCGGGU CGUCCGACAUGC (SEQ ID NO: 1005) | 1.323 | 125A |
| CCG_SMARCA4_30bp_guide_U-flip_30_7 | SMARCA4 | RESCUE | CCG | U/24 | P88L | GUAGCGCUGGUCGUCCGAC AUGCCCUUCUCA (SEQ ID NO: 1006) | 4.412 | 125A |
| CCG_SMARCA4_30bp_guide_U-flip_30_9 | SMARCA4 | RESCUE | CCG | U/22 | P88L | GUGUAGCGCUGGUCGUCCG ACAUGCCCUUCU (SEQ ID NO: 1007) | 2.911 | 125A |
| CCG_SMARCA4_30bp_guide_U-flip_30_11 | SMARCA4 | RESCUE | CCG | U/20 | P88L | GGUUGUAGCGCUGGUCGUC CGACAUGCCCUU (SEQ ID NO: 1008) | 4.819 | 125A |
| CCG_SMARCA4_30bp_guide_U-flip_30_13 | SMARCA4 | RESCUE | CCG | U/18 | P88L | GUGGUUGUAGCGCUGGUCG UCCGACAUGCCC (SEQ ID NO: 1009) | 0.841 | 125A |
| S33F_CTNNB1_30bp_C-flip_guide_30_7 | CTNNB1 | RESCUE | UCU | C/24 | S33F | GAUUCCACAGUCCAGGUAA GACUGUUGCUGC (SEQ ID NO: 1010) | 7.351 | 125B |
| S33F_CTNNB1_30bp_C-flip_guide_30_9 | CTNNB1 | RESCUE | UCU | C/22 | S33F | GGGAUUCCACAGUCCAGGU AAGACUGUUGCU (SEQ ID NO: 1011) | 8.783 | 125B |
| S33F_CTNNB1_30bp_C-flip_guide_30_11 | CTNNB1 | RESCUE | UCU | C/20 | S33F | GAUGGAUUCCACAGUCCAG GUAAGACUGUUG (SEQ ID NO: 1012) | 6.063 | 125B |
| S33F_CTNNB1_30bp_C-flip_guide_30_13 | CTNNB1 | RESCUE | UCU | C/18 | S33F | GGAAUGGAUUCCACAGUCC AGGUAAGACUGU (SEQ ID NO: 1013) | 7.893 | 125B |
| H36Y_CTNNB1_30bp_C-flip_guide_30_7 | CTNNB1 | RESCUE | CCA | C/24 | H36Y | GCAGAAUCGAUUCCAGAGU CCAGGUAAGACU (SEQ ID NO: 1014) | 0.406 | 125B |
| H36Y_CTNNB1_30bp_C-flip_guide_30_9 | CTNNB1 | RESCUE | CCA | C/22 | H36Y | GACCAGAAUCGAUUCCAGA GUCCAGGUAAGA (SEQ ID NO: 1015) | 1.178 | 125B |
| H36Y_CTNNB1_30bp_C-flip_guide_30_11 | CTNNB1 | RESCUE | CCA | C/20 | H36Y | GGCACCAGAAUCGAUUCCA GAGUCCAGGUAA (SEQ ID NO: 1016) | 0.369 | 125B |
| H36Y_CTNNB1_30bp_C-flip_guide_30_13 | CTNNB1 | RESCUE | CCA | C/18 | H36Y | GUGGCACCAGAAUCGAUUC CAGAGUCCAGGU (SEQ ID NO: 1017) | 0.589 | 125B |

TABLE 30-continued

| Guide sequences used for endogenous gene editing | | | | | | | | |
|---|---|---|---|---|---|---|---|---|
| Name | Targeted gene | REPAIR/ RESCUE | Motif | Base flip/ position | Codon change | Spacer sequence | Editing percentage (first figure) | First figure |
| S37F_CTNNB1_30bp_C-flip_guide_30_7 | CTNNB1 | RESCUE | UCU | C/24 | S37F | GGCACCACAAUGGAUUCCAGAGUCCAGGUAA (SEQ ID NO: 1018) | 7.132 | 125B |
| S37F_CTNNB1_30bp_C-flip_guide_30_9 | CTNNB1 | RESCUE | UCU | C/22 | S37F | GUGGCACCACAAUGGAUUCCAGAGUCCAGGU (SEQ ID NO: 1019) | 8.465 | 125B |
| S37F_CTNNB1_30bp_C-flip_guide_30_11 | CTNNB1 | RESCUE | UCU | C/20 | S37F | GAGUGGCACCACAAUGGAUUCCAGAGUCCAG (SEQ ID NO: 1020) | 9.422 | 125B |
| S37F_CTNNB1_30bp_C-flip_guide_30_13 | CTNNB1 | RESCUE | UCU | C/18 | S37F | GGUAGUGGCACCACAAUGGAUUCCAGAGUCC (SEQ ID NO: 1021) | 9.734 | 125B |
| T41I_CTNNB1_30bp_C-flip_guide_30_7 | CTNNB1 | RESCUE | ACC | C/24 | T41I | GGCUGUGCUAGUGGCACCAGAAUGGAUUCCA (SEQ ID NO: 1022) | 5.252 | 125B |
| T41I_CTNNB1_30bp_C-flip_guide_30_9 | CTNNB1 | RESCUE | ACC | C/22 | T41I | GGAGCUGUGCUAGUGGCACCAGAAUGGAUUC (SEQ ID NO: 1023) | 12.765 | 125B |
| T41I_CTNNB1_30bp_C-flip_guide_30_11 | CTNNB1 | RESCUE | ACC | C/20 | T41I | GAGGAGCUGUGCUAGUGGCACCAGAAUGGAU (SEQ ID NO: 1024) | 14.196 | 125B |
| T41I_CTNNB1_30bp_C-flip_guide_30_13 | CTNNB1 | RESCUE | ACC | C/18 | T41I | GGAAGGAGCUGUGCUAGUGGCACCAGAAUGG (SEQ ID NO: 1025) | 11.364 | 125B |
| P44L_CTNNB1_30bp_C-flip_guide_30_7 | CTNNB1 | RESCUE | CCU | C/24 | P44L | GAGAGAACGAGCUGUGGUAGUGGCACCAGAA (SEQ ID NO: 1026) | 4.636 | 125B |
| P44L_CTNNB1_30bp_C-flip_guide_30_9 | CTNNB1 | RESCUE | CCU | C/22 | P44L | GUCAGAGAACGAGCUGUGGUAGUGGCACCAG (SEQ ID NO: 1027) | 8.413 | 125B |
| P44L_CTNNB1_30bp_C-flip_guide_30_11 | CTNNB1 | RESCUE | CCU | C/20 | P44L | GACUCAGAGAACGAGCUGUGGUAGUGGCACC (SEQ ID NO: 1028) | 8.276 | 125B |
| P44L_CTNNB1_30bp_C-flip_guide_30_13 | CTNNB1 | RESCUE | CCU | C/18 | P44L | GCCACUCAGAGAACGAGCUGUGGUAGUGGCA (SEQ ID NO: 1029) | 1.775 | 125B |
| P445_CTNNB1_30bp_C-flip_guide_30_7 | CTNNB1 | RESCUE | UCU | C/24 | P44S | GGAGAAGCAGCUGUGGUAGUGGCACCAGAAU (SEQ ID NO: 1030) | 15.256 | 125B |
| P445_CTNNB1_30bp_C-flip_guide_30_9 | CTNNB1 | RESCUE | UCU | C/22 | P44S | GCAGAGAAGCAGCUGUGGUAGUGGCACCAGA (SEQ ID NO: 1031) | 14.639 | 125B |
| P445_CTNNB1_30bp_C-flip_guide_30_11 | CTNNB1 | RESCUE | UCU | C/20 | P44S | GCUCAGAGAAGCAGCUGUGGUAGUGGCACCA (SEQ ID NO: 1032) | 13.489 | 125B |
| P445_CTNNB1_30bp_C-flip_guide_30_13 | CTNNB1 | RESCUE | UCU | C/18 | P44S | GCACUCAGAGAAGCAGCUGUGGUAGUGGCAC (SEQ ID NO: 1033) | 13.906 | 125B |
| S45F_CTNNB1_30bp_C-flip_guide_30_7 | CTNNB1 | RESCUE | UCU | C/24 | S45F | GCUCAGACAAGGAGCUGUGGUAGUGGCACCA (SEQ ID NO: 1034) | 6.550 | 125B |
| S45F_CTNNB1_30bp_C-flip_guide_30_9 | CTNNB1 | RESCUE | UCU | C/22 | S45F | GCACUCAGACAAGGAGCUGUGGUAGUGGCAC (SEQ ID NO: 1035) | 8.816 | 125B |

TABLE 30-continued

| Name | Target-ed gene | REPAIR/ RESCUE | Motif | Base flip/ posi-tion | Codon change | Spacer sequence | Editing percent-age (first figure) | First fig-ure |
|---|---|---|---|---|---|---|---|---|
| Guide sequences used for endogenous gene editing | | | | | | | | |
| S45F_CTNNB1_30bp_C-flip_guide_30_11 | CTNNB1 | RESCUE | UCU | C/20 | S45F | GACCACUCAGACAAGGAGC UGUGGUAGUGGC (SEQ ID NO: 1036) | 11.980 | 125B |
| S45F_CTNNB1_30bp_C-flip_guide_30_13 | CTNNB1 | RESCUE | UCU | C/18 | S45F | GUUACCACUCAGACAAGGA GCUGUGGUAGUG (SEQ ID NO: 1037) | 7.397 | 125B |
| TCG_KRAS_30bp_C-flip_guide_30_7 | KRAS | RESCUE | UCG | C/24 | L56L | GUGUGUCCAGAAUAUCCAA GAGACAGGUUUC (SEQ ID NO: 1038) | 13.024 | 125B |
| TCG_KRAS_30bp_C-flip_guide_30_9 | KRAS | RESCUE | UCG | C/22 | L56L | GGCUGUGUCCAGAAUAUCC AAGAGACAGGUU (SEQ ID NO: 1039) | 8.716 | 125B |
| TCG_KRAS_30bp_C-flip_guide_30_11 | KRAS | RESCUE | UCG | C/20 | L56L | GCUGCUGUGUCCAGAAUAU CCAAGAGACAGG (SEQ ID NO: 1040) | 10.067 | 125B |
| TCG_KRAS_30bp_C-flip_guide_30_13 | KRAS | RESCUE | UCG | C/18 | L56L | GACCUGCUGUGUCCAGAAU AUCCAAGAGACA (SEQ ID NO: 1041) | 6.656 | 125B |
| ACG_KRAS_30bp_C-flip_guide_30_7 | KRAS | RESCUE | ACG | C/24 | D30D | GAUAUUCCUCCACAAAAUG AUUCUGAAUUAG (SEQ ID NO: 1042) | 13.954 | 125B |
| ACG_KRAS_30bp_C-flip_guide_30_9 | KRAS | RESCUE | ACG | C/22 | D30D | GUCAUAUUCCUCCACAAAA UGAUUCUGAAUU (SEQ ID NO: 1043) | 12.962 | 125B |
| ACG_KRA5_30bp_C-flip_guide_30_11 | KRAS | RESCUE | ACG | C/20 | D30D | GGAUCAUAUUCCUCCACAA AAUGAUUCUGAA (SEQ ID NO: 1044) | 23.138 | 125B |
| ACG_KRAS_30bp_C-flip_guide_30_13 | KRAS | RESCUE | ACG | C/18 | D30D | GUGGAUCAUAUUCCUCCAC AAAAUGAUUCUG (SEQ ID NO: 1045) | 16.629 | 125B |
| GCG_KRAS_30bp_C-flip_guide_30_7 | KRAS | RESCUE | GCG | C/24 | G13G | GGCCUACCCCACCAGCUCC AACUACCACAAG (SEQ ID NO: 1046) | 0.394 | 125B |
| GCG_KRAS_30bp_C-flip_guide_30_9 | KRAS | RESCUE | GCG | C/22 | G13G | GUUGCCUACCCCACCAGCU CCAACUACCACA (SEQ ID NO: 1047) | 0.886 | 125B |
| GCG_KRAS_30bp_C-flip_guide_30_11 | KRAS | RESCUE | GCG | C/20 | G13G | GUCUUGCCUACCCCACCAG CUCCAACUACCA (SEQ ID NO: 1048) | 0.950 | 125B |
| GCG_KRAS_30bp_C-flip_guide_30_13 | KRAS | RESCUE | GCG | C/18 | G13G | GACUCUUGCCUACCCCACC AGCUCCAACUAC (SEQ ID NO: 1049) | 0.311 | 125B |
| CCT_KRAS_30bp_C-flip_guide_30_7 | KRAS | RESCUE | CCU | C/24 | A18A | GCGUCAACGCACUCUUGCC UACGCCACCAGC (SEQ ID NO: 1050) | 1.407 | 125B |
| CCT_KRAS_30bp_C-flip_guide_30_9 | KRAS | RESCUE | CCU | C/22 | A18A | GAUCGUCAACGCACUCUUG CCUACGCCACCA (SEQ ID NO: 1051) | 5.431 | 125B |
| CCT_KRAS_30bp_C-flip_guide_30_11 | KRAS | RESCUE | CCU | C/20 | A18A | GGUAUCGUCAACGCACUCU UGCCUACGCCAC (SEQ ID NO: 1052) | 7.769 | 125B |
| CCT_KRAS_30bp_C-flip_guide_30_13 | KRAS | RESCUE | CCU | C/18 | A18A | GCUGUAUCGUCAACGCACU CUUGCCUACGCC (SEQ ID NO: 1053) | 1.685 | 125B |

TABLE 30-continued

| Name | Targeted gene | REPAIR/RESCUE | Motif | Base flip/position | Codon change | Spacer sequence | Editing percentage (first figure) | First figure |
|---|---|---|---|---|---|---|---|---|
| Guide sequences used for endogenous gene editing | | | | | | | | |
| TCG_PPIB_30bp_C-flip_guide_30_7 | PPIB | RESCUE | UCG | C/24 | I18I | GCCCCGCCAUGAGGGCGGCGGCAAGGAGCAC (SEQ ID NO: 1054) | 4.128 | 125B |
| TCG_PP1B_30bp_C-flip_guide_30_9 | PPIB | RESCUE | UCG | C/22 | I18I | GGACCCCGCCAUGAGGGCGGCGGCAAGGAGC (SEQ ID NO: 1055) | 6.324 | 125B |
| TCG_PPIB_30bp_C-flip_guide_30_11 | PPIB | RESCUE | UCG | C/20 | I18I | GCGGACCCCGCCAUGAGGGCGGCGGCAAGGA (SEQ ID NO: 1056) | 6.386 | 125B |
| TCG_PPIB_30bp_C-flip_guide_30_13 | PPIB | RESCUE | UCG | C/18 | I18I | GGACGGACCCCGCCAUGAGGGCGGCGGCAAG (SEQ ID NO: 1057) | 5.348 | 125B |
| ACG_PPIB_30bp_C-flip_guide_30_7 | PPIB | RESCUE | ACG | C/24 | R7C | GUGUUGCCUUCGGAGAGGCGCAGCAUCCACA (SEQ ID NO: 1058) | 28.575 | 125B |
| ACG_PPIB_30bp_C-flip_guide_30_9 | PPIB | RESCUE | ACG | C/22 | R7C | GCAUGUUGCCUUCGGAGAGGCGCAGCAUCCA (SEQ ID NO: 1059) | 24.992 | 125B |
| ACG_PPIB_30bp_C-flip_guide_30_11 | PPIB | RESCUE | ACG | C/20 | R7C | GUUCAUGUUGCCUUCGGAGAGGCGCAGCAUC (SEQ ID NO: 1060) | 24.160 | 125B |
| ACG_PPIB_30bp_C-flip_guide_30_13 | PPIB | RESCUE | ACG | C/18 | R7C | GCCUUCAUGUUGCCUUCGGAGAGGCGCAGCA (SEQ ID NO: 1061) | 5.582 | 125B |
| GCG_PPIB_30bp_C-flip_guide_30_7 | PPIB | RESCUE | GCG | C/24 | A19V | GGACCCCCCGAUGAGGGCGGCGGCAAGGAGC (SEQ ID NO: 1062) | 0.584 | 125B |
| GCG_PPIB_30bp_C-flip_guide_30_9 | PPIB | RESCUE | GCG | C/22 | A19V | GCGGACCCCCCGAUGAGGGCGGCGGCAAGGA (SEQ ID NO: 1063) | 5.708 | 125B |
| GCG_PPIB_30bp_C-flip_guide_30_11 | PPIB | RESCUE | GCG | C/20 | A19V | GGACGGACCCCCCGAUGAGGGCGGCGGCAAG (SEQ ID NO: 1064) | 3.700 | 125B |
| GCG_PPIB_30bp_C-flip_guide_30_13 | PPIB | RESCUE | GCG | C/18 | A19V | GAAGACGGACCCCCCGAUGAGGGCGGCGGCA (SEQ ID NO: 1065) | 0.667 | 125B |
| CCG_PPIB_30bp_C-flip_guide_30_7 | PPIB | RESCUE | CCG | C/24 | S21S | GGAAGACCGACCCCGCGAUGAGGGCGGCGGC (SEQ ID NO: 1066) | 3.719 | 125B |
| CCG_PPIB_30bp_C-flip_guide_30_9 | PPIB | RESCUE | CCG | C/22 | S21S | GAAGAAGACCGACCCCGCGAUGAGGGCGGCG (SEQ ID NO: 1067) | 4.255 | 125B |
| CCG_PPIB_30bp_C-flip_guide_30_11 | PPIB | RESCUE | CCG | C/20 | S21S | GGGAAGAAGACCGACCCCGCGAUGAGGGCGG (SEQ ID NO: 1068) | 6.843 | 125B |
| CCG_PPIB_30bp_C-flip_guide_30_13 | PPIB | RESCUE | CCG | C/18 | S21S | GCAGGAAGAAGACCGACCCCGCGAUGAGGGC (SEQ ID NO: 1069) | 4.263 | 125B |
| TCG_SMARCA4_30bp_C-flip_guide_30_7 | SMARCA4 | RESCUE | UCG | C/24 | S85L | GUCGUCCCACAUGCCCUUCUCAUGCAUGGAC (SEQ ID NO: 1070) | 4.081 | 125B |
| TCG_SMARCA4_30bp_C-flip_guide_30_9 | SMARCA4 | RESCUE | UCG | C/22 | S85L | GGGUCGUCCCACAUGCCCUUCUCAUGCAUGG (SEQ ID NO: 1071) | 3.132 | 125B |

TABLE 30-continued

Guide sequences used for endogenous gene editing

| Name | Targeted gene | REPAIR/ RESCUE | Motif | Base flip/ position | Codon change | Spacer sequence | Editing percentage (first figure) | First figure |
|---|---|---|---|---|---|---|---|---|
| TCG_SMARCA4_30bp_C-flip_guide_30_11 | SMARCA4 | RESCUE | UCG | C/20 | S85L | GCGGGUCGUCCCACAUGCC CUUCUCAUGCAU (SEQ ID NO: 1072) | 0.918 | 125B |
| TCG_SMARCA4_30bp_C-flip_guide_30_13 | SMARCA4 | RESCUE | UCG | C/18 | S85L | GCGCGGGUCGUCCCACAUG CCCUUCUCAUGC (SEQ ID NO: 1073) | 1.830 | 125B |
| ACG_SMARCA4_30bp_C-flip_guide_30_7 | SMARCA4 | RESCUE | ACG | C/24 | D86D | GCGGGUCCUCCGACAUGCC CUUCUCAUGCAU (SEQ ID NO: 1074) | 2.425 | 125B |
| ACG_SMARCA4_30bp_C-flip_guide_30_9 | SMARCA4 | RESCUE | ACG | C/22 | D86D | GCGCGGGUCCUCCGACAUG CCCUUCUCAUGC (SEQ ID NO: 1075) | 3.392 | 125B |
| ACG_SMARCA4_30bp_C-flip_guide_30_11 | SMARCA4 | RESCUE | ACG | C/20 | D86D | GAGCGCGGGUCCUCCGACA UGCCCUUCUCAU (SEQ ID NO: 1076) | 4.485 | 125B |
| ACG_SMARCA4_30bp_C-flip_guide_30_13 | SMARCA4 | RESCUE | ACG | C/18 | D86D | GGUAGCGCGGGUCCUCCGA CAUGCCCUUCUC (SEQ ID NO: 1077) | 3.071 | 125B |
| GCG_SMARCA4_30bp_C-flip_guide_30_7 | SMARCA4 | RESCUE | GCG | C/24 | R89C | GUGUAGCCCGGGUCGUCCG ACAUGCCCUUCU (SEQ ID NO: 1078) | 0.225 | 125B |
| GCG_SMARCA4_30bp_C-flip_guide_30_9 | SMARCA4 | RESCUE | GCG | C/22 | R89C | GGUUGUAGCCCGGGUCGUC CGACAUGCCCUU (SEQ ID NO: 1079) | 1.026 | 125B |
| GCG_SMARCA4_30bp_C-flip_guide_30_11 | SMARCA4 | RESCUE | GCG | C/20 | R89C | GUGGUUGUAGCCCGGGUCG UCCGACAUGCCC (SEQ ID NO: 1080) | 1.737 | 125B |
| GCG_SMARCA4_30bp_C-flip_guide_30_13 | SMARCA4 | RESCUE | GCG | C/18 | R89C | GUCUGGUUGUAGCCCGGGU CGUCCGACAUGC (SEQ ID NO: 1081) | 0.603 | 125B |
| CCG_SMARCA4_30bp_C-flip_guide_30_7 | SMARCA4 | RESCUE | CCG | C/24 | P88L | GUAGCGCCGGUCGUCCGAC AUGCCCUUCUCA (SEQ ID NO: 1082) | 2.895 | 125B |
| CCG_SMARCA4_30bp_C-flip_guide_30_9 | SMARCA4 | RESCUE | CCG | C/22 | P88L | GUGUAGCGCCGGUCGUCCG ACAUGCCCUUCU (SEQ ID NO: 1083) | 2.766 | 125B |
| CCG_SMARCA4_30bp_C-flip_guide_30_11 | SMARCA4 | RESCUE | CCG | C/20 | P88L | GGUUGUAGCGCCGGUCGUC CGACAUGCCCUU (SEQ ID NO: 1084) | 4.845 | 125B |
| CCG_SMARCA4_30bp_C-flip_guide_30_13 | SMARCA4 | RESCUE | CCG | C/18 | P88L | GUGGUUGUAGCGCCGGUCG UCCGACAUGCCC (SEQ ID NO: 1085) | 0.684 | 125B |
| NRAS_30bp_C-flip_guide_30_3 | NRAS | RESCUE | UCC | C/28 | I21I | GUGCAUUGUCAGUGCGCUU UUCCCAACACCA (SEQ ID NO: 1086) | 2.714 | 125C |
| NRAS_30bp_C-flip_guide_30_5 | NRAS | RESCUE | UCC | C/26 | I21I | GGCUGCAUUGUCAGUGCGC UUUUCCCAACAC (SEQ ID NO: 1087) | 8.839 | 125C |
| NRAS_30bp_C-flip_guide_30_7 | NRAS | RESCUE | UCC | C/24 | I21I | GUAGCUGCAUUGUCAGUGC GCUUUUCCCAAC (SEQ ID NO: 1088) | 10.690 | 125C |
| NRAS_30bp_C-flip_guide_30_9 | NRAS | RESCUE | UCC | C/22 | I21I | GAUUAGCUGCAUUGUCAGU GCGCUUUUCCCA (SEQ ID NO: 1089) | 13.278 | 125C |

TABLE 30-continued

Guide sequences used for endogenous gene editing

| Name | Targeted gene | REPAIR/ RESCUE | Motif | Base flip/ position | Codon change | Spacer sequence | Editing percentage (first figure) | First figure |
|---|---|---|---|---|---|---|---|---|
| NRAS_30bp_C-flip_guide_30_11 | NRAS | RESCUE | UCC | C/20 | I21I | GGGAUUAGCUGCAUUGUCA GUGCGCUUUUCC (SEQ ID NO: 1090) | 18.858 | 125C |
| NKFB1_30bp_C-flip_guide_30_3 | NKFB1 | RESCUE | ACC | C/28 | P33S | GUGCUUGAAAUACUUCUGG AUUAAAUAUUGU (SEQ ID NO: 1091) | 16.138 | 125C |
| NKFB1_30bp_C-flip_guide_30_5 | NKFB1 | RESCUE | ACC | C/26 | P33S | GUGUGCUUGAAAUACUUCU GGAUUAAAUAUU (SEQ ID NO: 1092) | 9.580 | 125C |
| NKFB1_30bp_C-flip_guide_30_7 | NKFB1 | RESCUE | ACC | C/24 | P33S | GUCUGUGCUUGAAAUACUU CUGGAUUAAAUA (SEQ ID NO: 1093) | 14.701 | 125C |
| NKFB1_30bp_C-flip_guide_30_9 | NKFB1 | RESCUE | ACC | C/22 | P33S | GCAUCUGUGCUUGAAAUAC UUCUGGAUUAAA (SEQ ID NO: 1094) | 13.808 | 125C |
| NKFB1_30bp_C-flip_guide_30_11 | NKFB1 | RESCUE | ACC | C/20 | P33S | GGCCAUCUGUGCUUGAAAU ACUUCUGGAUUA (SEQ ID NO: 1095) | 21.529 | 125C |
| EZH2_30bp_C-flip_guide_30_3 | EZH2 | RESCUE | UCA | C/28 | F32F | GCUCAACCUCUUGAGCUGU CUCAGUCGCAUG (SEQ ID NO: 1096) | 2.696 | 125C |
| EZH2_30bp_C-flip_guide_30_5 | EZH2 | RESCUE | UCA | C/26 | F32F | GGUCUCAACCUCUUGAGCU GUCUCAGUCGCA (SEQ ID NO: 1097) | 0.106 | 125C |
| EZH2_30bp_C-flip_guide_30_7 | EZH2 | RESCUE | UCA | C/24 | F32F | GUCGUCUCAACCUCUUGAG CUGUCUCAGUCG (SEQ ID NO: 1098) | 11.539 | 125C |
| EZH2_30bp_C-flip_guide_30_9 | EZH2 | RESCUE | UCA | C/22 | F32F | GGCUCGUCUCAACCUCUUG AGCUGUCUCAGU (SEQ ID NO: 1099) | 10.710 | 125C |
| EZH2_30bp_C-flip_guide_30_11 | EZH2 | RESCUE | UCA | C/20 | F32F | GCAGCUCGUCUCAACCUCU UGAGCUGUCUCA (SEQ ID NO: 1100) | 15.855 | 125C |
| NF2_30bp_C-flip_guide_30_3 | NF2 | RESCUE | ACG | C/28 | T21M | GACCUCUUGGGUUGCUUCC UCUUGAGAGAGC (SEQ ID NO: 1101) | 8.318 | 125C |
| NF2_30bp_C-flip_guide_30_5 | NF2 | RESCUE | ACG | C/26 | T21M | GGAACCUCUUGGGUUGCUU CCUCUUGAGAGA (SEQ ID NO: 1102) | 18.846 | 125C |
| NF2_30bp_C-flip_guide_30_7 | NF2 | RESCUE | ACG | C/24 | T21M | GGUGAACCUCUUGGGUUGC UUCCUCUUGAGA (SEQ ID NO: 1103) | 18.617 | 125C |
| NF2_30bp_C-flip_guide_30_9 | NF2 | RESCUE | ACG | C/22 | T21M | GCGGUGAACCUCUUGGGUU GCUUCCUCUUGA (SEQ ID NO: 1104) | 24.904 | 125C |
| NF2_30bp_C-flip_guide_30_11 | NF2 | RESCUE | ACG | C/20 | T21M | GCACGGUGAACCUCUUGGG UUGCUUCCUCUU (SEQ ID NO: 1105) | 14.735 | 125C |
| RAF1_30bp_C-flip_guide_30_3 | RAF1 | RESCUE | UCC | C/28 | P30S | GAGCAGAGAUGCAGCUGGA GCCAUCAAACAC (SEQ ID NO: 1106) | 8.257 | 125C |
| RAF1_30bp_C-flip_guide_30_5 | RAF1 | RESCUE | UCC | C/26 | P30S | GGUAGCAGAGAUGCAGCUG GAGCCAUCAAAC (SEQ ID NO: 1107) | 14.435 | 125C |

TABLE 30-continued

| Name | Targeted gene | REPAIR/ RESCUE | Motif | Base flip/ position | Codon change | Spacer sequence | Editing percentage (first figure) | First figure |
|---|---|---|---|---|---|---|---|---|
| Guide sequences used for endogenous gene editing | | | | | | | | |
| RAF1_30bp_C-flip_guide_30_7 | RAF1 | RESCUE | UCC | C/24 | P30S | GUUGUAGCAGAGAUGCAGCUGGAGCCAUCAA (SEQ ID NO: 1108) | 20.867 | 125C |
| RAF1_30bp_C-flip_guide_30_9 | RAF1 | RESCUE | UCC | C/22 | P30S | GUAUUGUAGCAGAGAUGCAGCUGGAGCCAUC (SEQ ID NO: 1109) | 13.821 | 125C |
| RAF1_30bp_C-flip_guide_30_11 | RAF1 | RESCUE | UCC | C/20 | P30S | GACUAUUGUAGCAGAGAUGCAGCUGGAGCCA (SEQ ID NO: 1110) | 16.277 | 125C |
| NRAS_30bp_U-flip_guide_30_3 | NRAS | RESCUE | UCC | U/28 | I21I | GUGUAUUGUCAGUGCGCUUUUCCCAACACCA (SEQ ID NO: 1111) | 3.500 | 125C |
| NRAS_30bp_U-flip_guide_30_5 | NRAS | RESCUE | UCC | U/26 | I21I | GGCUGUAUUGUCAGUGCGCUUUUCCCAACAC (SEQ ID NO: 1112) | 8.805 | 125C |
| NRAS_30bp_U-flip_guide_30_7 | NRAS | RESCUE | UCC | U/24 | I21I | GUAGCUGUAUUGUCAGUGCGCUUUUCCCAAC (SEQ ID NO: 1113) | 12.296 | 125C |
| NRAS_30bp_U-flip_guide_30_9 | NRAS | RESCUE | UCC | U/22 | I21I | GAUUAGCUGUAUUGUCAGUGCGCUUUUCCCA (SEQ ID NO: 1114) | 12.521 | 125C |
| NRAS_30bp_U-flip_guide_30_11 | NRAS | RESCUE | UCC | U/20 | I21I | GGGAUUAGCUGUAUUGUCAGUGCGCUUUUCC (SEQ ID NO: 1115) | 18.399 | 125C |
| NKFB1_30bp_U-flip_guide_30_3 | NKFB1 | RESCUE | ACC | U/28 | P33S | GUGUUUGAAAUACUUCUGGAUUAAAUAUUGU (SEQ ID NO: 1116) | 14.277 | 125C |
| NKFB1_30bp_U-flip_guide_30_5 | NKFB1 | RESCUE | ACC | U/26 | P33S | GUGUGUUUGAAAUACUUCUGGAUUAAAUAUU (SEQ ID NO: 1117) | 10.928 | 125C |
| NKFB1_30bp_U-flip_guide_30_7 | NKFB1 | RESCUE | ACC | U/24 | P33S | GUCUGUGUUUGAAAUACUUCUGGAUUAAAUA (SEQ ID NO: 1118) | 18.012 | 125C |
| NKFB1_30bp_U-flip_guide_30_9 | NKFB1 | RESCUE | ACC | U/22 | P33S | GCAUCUGUGUUUGAAAUACUUCUGGAUUAAA (SEQ ID NO: 1119) | 21.468 | 125C |
| NKFB1_30bp_U-flip_guide_30_11 | NKFB1 | RESCUE | ACC | U/20 | P33S | GGCCAUCUGUGUUUGAAAUACUUCUGGAUUA (SEQ ID NO: 1120) | 24.376 | 125C |
| EZH2_30bp_U-flip_guide_30_3 | EZH2 | RESCUE | UCA | U/28 | F32F | GCUUAACCUCUUGAGCUGUCUCAGUCGCAUG (SEQ ID NO: 1121) | 9.307 | 125C |
| EZH2_30bp_U-flip_guide_30_5 | EZH2 | RESCUE | UCA | U/26 | F32F | GGUCUUAACCUCUUGAGCUGUCUCAGUCGCA (SEQ ID NO: 1122) | 9.393 | 125C |
| EZH2_30bp_U-flip_guide_30_7 | EZH2 | RESCUE | UCA | U/24 | F32F | GUCGUCUUAACCUCUUGAGCUGUCUCAGUCG (SEQ ID NO: 1123) | 8.525 | 125C |
| EZH2_30bp_U-flip_guide_30_9 | EZH2 | RESCUE | UCA | U/22 | F32F | GGCUCGUCUUAACCUCUUGAGCUGUCUCAGU (SEQ ID NO: 1124) | 6.976 | 125C |
| EZH2_30bp_U-flip_guide_30_11 | EZH2 | RESCUE | UCA | U/20 | F32F | GCAGCUCGUCUUAACCUCUUGAGCUGUCUCA (SEQ ID NO: 1125) | 9.534 | 125C |

TABLE 30-continued

| Guide sequences used for endogenous gene editing | | | | | | | | |
|---|---|---|---|---|---|---|---|---|
| Name | Target-ed gene | REPAIR/ RESCUE | Motif | Base flip/ posi-tion | Codon change | Spacer sequence | Editing percent-age (first figure) | First fig-ure |
| NF2_30bp_U-flip_guide_30_3 | NF2 | RESCUE | ACG | U/28 | T21M | GACUUCUUGGGUUGCUUCC UCUUGAGAGAGC (SEQ ID NO: 1126) | 7.253 | 125C |
| NF2_30bp_U-flip_guide_30_5 | NF2 | RESCUE | ACG | U/26 | T21M | GGAACUUCUUGGGUUGCUU CCUCUUGAGAGA (SEQ ID NO: 1127) | 16.618 | 125C |
| NF2_30bp_U-flip_guide_30_7 | NF2 | RESCUE | ACG | U/24 | T21M | GGUGAACUUCUUGGGUUGC UUCCUCUUGAGA (SEQ ID NO: 1128) | 15.696 | 125C |
| NF2_30bp_U-flip_guide_30_9 | NF2 | RESCUE | ACG | U/22 | T21M | GCGGUGAACUUCUUGGGUU GCUUCCUCUUGA (SEQ ID NO: 1129) | 18.984 | 125C |
| NF2_30bp_U-flip_guide_30_11 | NF2 | RESCUE | ACG | U/20 | T21M | GCACGGUGAACUUCUUGGG UUGCUUCCUCUU (SEQ ID NO: 1130) | 16.393 | 125C |
| RAF1_30bp_U-flip_guide_30_3 | RAF1 | RESCUE | UCC | U/28 | P30S | GAGUAGAGAUGCAGCUGGA GCCAUCAAACAC (SEQ ID NO: 1131) | 9.450 | 125C |
| RAF1_30bp_U-flip_guide_30_5 | RAF1 | RESCUE | UCC | U/26 | P30S | GGUAGUAGAGAUGCAGCUG GAGCCAUCAAAC (SEQ ID NO: 1132) | 15.056 | 125C |
| RAF1_30bp_U-flip_guide_30_7 | RAF1 | RESCUE | UCC | U/24 | P30S | GUUGUAGUAGAGAUGCAGC UGGAGCCAUCAA (SEQ ID NO: 1133) | 20.868 | 125C |
| RAF1_30bp_U-flip_guide_30_9 | RAF1 | RESCUE | UCC | U/22 | P30S | GUAUUGUAGUAGAGAUGCA GCUGGAGCCAUC (SEQ ID NO: 1134) | 15.518 | 125C |
| RAF1_30bp_U-flip_guide_30_11 | RAF1 | RESCUE | UCC | U/20 | P30S | GACUAUUGUAGUAGAGAUG CAGCUGGAGCCA (SEQ ID NO: 1135) | 20.003 | 125C |
| STAT3 S727 C-flip | STAT3 | RESCUE | UCC | C/22 | S727F | GUGCGGGGGCACAUCGGCA GGUCAAUGGUAU (SEQ ID NO: 1136) | 6.127 | 129B |
| STAT3 S727 U-flip | STAT3 | RESCUE | UCC | U/22 | S727F | GUGCGGGGGUACAUCGGCA GGUCAAUGGUAU (SEQ ID NO: 1137) | 3.132 | 129B |
| STAT3 S727 G-flip | STAT3 | RESCUE | UCC | G/22 | S727F | GUGCGGGGGGACAUCGGCA GGUCAAUGGUAU (SEQ ID NO: 1138) | 0.154 | 129B |
| STAT3 S727 A-flip | STAT3 | RESCUE | UCC | A/22 | S727F | GUGCGGGGGAACAUCGGCA GGUCAAUGGUAU (SEQ ID NO: 1139) | 0.156 | 129B |
| STAT1 S727 C-flip | STAT1 | RESCUE | UCC | C/22 | S727F | GCCUCAGGACACAUGGGGA GCAGGUUGUCUG (SEQ ID NO: 1140) | 1.141 | 129D |
| STAT1 S727 U-flip | STAT1 | RESCUE | UCC | U/22 | S727F | GCCUCAGGAUACAUGGGGA GCAGGUUGUCUG (SEQ ID NO: 1141) | 0.801 | 129D |
| STAT1 S727 G-flip | STAT1 | RESCUE | UCC | G/22 | S727F | GCCUCAGGAGACAUGGGGA GCAGGUUGUCUG (SEQ ID NO: 1142) | 0.223 | 129D |
| STAT1 S727 A-flip | STAT1 | RESCUE | UCC | A/22 | S727F | GCCUCAGGAAACAUGGGGA GCAGGUUGUCUG (SEQ ID NO: 1143) | 0.193 | 129D |

TABLE 30-continued

Guide sequences used for endogenous gene editing

| Name | Target-ed gene | REPAIR/ RESCUE | Motif | Base flip/ posi-tion | Codon change | Spacer sequence | Editing percent-age (first figure) | First fig-ure |
|---|---|---|---|---|---|---|---|---|
| STAT1 Y701 C-flip | STAT1 | REPAIR | UAU | C/34 | Y701C | GCAACUCAGUCUUGAUACA UCCAGUUCCUUUAGGGCCA UCAAGUUCCAUUG (SEQ ID NO: 1144) | 1.289 | 129E |
| STAT1 Y701 U-flip | STAT1 | REPAIR | UAU | U/34 | Y701C | GCAACUCAGUCUUGAUAUA UCCAGUUCCUUUAGGGCCA UCAAGUUCCAUUG (SEQ ID NO: 1145) | 0.050 | 129E |
| STAT1 Y701 G-flip | STAT1 | REPAIR | UAU | G/34 | Y701C | GCAACUCAGUCUUGAUAGA UCCAGUUCCUUUAGGGCCA UCAAGUUCCAUUG (SEQ ID NO: 1146) | 0.011 | 129E |
| STAT3 Y705 C-flip | STAT3 | REPAIR | UAC | C/34 | Y705C | GAAACUUGGUCUUCAGGCA UGGGGCAGCGCUACCUGGG UCAGCUUCAGGAU (SEQ ID NO: 1147) | 5.080 | 139B |
| STAT3_S727_30_5 | STAT3 | RESCUE | UCC | C/26 | S727F | GGGGGACAUCGGCAGGUCA AUGGUAUUGCU (SEQ ID NO: 1148) | 4.842 | 139C |
| STAT3_S727_30_7 | STAT3 | RESCUE | UCC | C/24 | S727F | CGGGGGGACAUCGGCAGGU CAAUGGUAUUG (SEQ ID NO: 1149) | 2.990 | 139C |
| STAT3_S727_30_11 | STAT3 | RESCUE | UCC | C/20 | S727F | AGUGCGGGGGGACAUCGGC AGGUCAAUGGU (SEQ ID NO: 1150) | 6.786 | 139C |
| STAT1_S727_30_5 | STAT1 | RESCUE | UCC | C/26 | S727F | AGGAGACAUGGGGAGCAGG UUGUCUGUGGU (SEQ ID NO: 1151) | 2.128 | 139C |
| STAT1_S727_30_7 | STAT1 | RESCUE | UCC | C/24 | S727F | UCAGGAGACAUGGGGAGCA GGUUGUCUGUG (SEQ ID NO: 1152) | 3.215 | 139C |
| STAT1_S727_30_11 | STAT1 | RESCUE | UCC | C/20 | S727F | CUCCUCAGGAGACAUGGGG AGCAGGUUGUC (SEQ ID NO: 1153) | 2.146 | 139C |

TABLE 31

Guide sequences used for synthetic target editing

| Name | Target-ed gene | REPAIR/ RESCUE | Motif | Base flip/ posi-tion | Codon change | Spacer sequence | Editing percent-age (first figure) | First figure |
|---|---|---|---|---|---|---|---|---|
| NM_000016.5_C-flip_guide | ACADM | RESCUE | ACA | C/7 | H67Y | GUAUCAUCUUCUGCAGCC ACUGGGAUGAUUU (SEQ ID NO: 1154) | 7.500 | 127A |
| NM_000018.3_C-flip_guide | ACADVL | RESCUE | GCG | C/9 | A283V | GUCUCCACCCCAAAAGCU GUGAUCUUCUCCU (SEQ ID NO: 1155) | 6.274 | 127A |
| NM_000071.2_C-flip_guide | CBS | RESCUE | GCG | C/9 | R109C | GGAACUCACCCUUGGCCA AGAGCUCACACUU (SEQ ID NO: 1156) | 6.140 | 127A |
| NM_000138.4_C-flip_guide | FBN1 | RESCUE | GCG | C/5 | R1408C | GGAGCCCUCAUCAAGGUC UGUACAAGUGAAG (SEQ ID NO: 1157) | 13.751 | 127A |

TABLE 31-continued

Guide sequences used for synthetic target editing

| Name | Targeted gene | REPAIR/ RESCUE | Motif | Base flip/ position | Codon change | Spacer sequence | Editing percentage (first figure) | First figure |
|---|---|---|---|---|---|---|---|---|
| NM_000141.4_C-flip_guide | FGFR2 | RESCUE | CCC | C/7 | P267S | GCUGUGGCGGCAUUUGCC GGCAGUCCGGCUU (SEQ ID NO: 1158) | 16.131 | 127A |
| NM_000152.4_C-flip_guide | GAA | RESCUE | CCC | C/7 | P552L | GGCCUGGCGGGUCCCCCC AACCACCCCAGGC (SEQ ID NO: 1159) | 2.644 | 127A |
| NM_000341.3_C-flip_guide | SLC3A1 | RESCUE | ACG | C/7 | T467M | GAGAAGCCUGUUCAUCAC GUUGACAUACUGA (SEQ ID NO: 1160) | 28.198 | 127A |
| NM_000375.2_C-flip_guide | UROS | RESCUE | ACG | C/9 | R73C | GCUCCAAACCUAACUCUG CUGCUUCCACUGC (SEQ ID NO: 1161) | 13.632 | 127A |
| NM_000431.3_C-flip_guide | MVK | RESCUE | ACA | C/9 | T268I | GUGGCAUCUCUUGAGGUC AGGAGGGGGGCCA (SEQ ID NO: 1162) | 13.775 | 127A |
| NM_000551.3_C-flip_guide | VHL | RESCUE | CCG | C/7 | P158L | GUCUUUCCGAGUAUACAC UGGCAGUGUGAUA (SEQ ID NO: 1163) | 22.466 | 127A |
| NM_001256850.1_C-flip_guide | TTN | RESCUE | ACG | C/9 | R30071C | GCUUUCCACCUGGGCCAG GGGAAUCAAGCAC (SEQ ID NO: 1164) | 23.207 | 127A |
| NM_002397.4_C-flip_guide | MEF2C | RESCUE | ACG | C/9 | T1M | GUUCUCCCCCUAGUCCCC GUUUUUCUUCUCU (SEQ ID NO: 1165) | 2.313 | 127A |
| NM_002474.2_C-flip_guide | MYH11 | RESCUE | CCG | C/9 | P1264L | GUGGACUGCCGCUCCUGC ACCUGCGCCUCCA (SEQ ID NO: 1166) | 34.770 | 127A |
| NM_002834.4_C-flip_guide | PTPN11 | RESCUE | CCU | C/9 | L285F | GAUGAUCAACGGGCAGGA UGUUUUUAUAUCU (SEQ ID NO: 1167) | 0.711 | 127A |
| NM_004004.5_C-flip_guide | GJB2 | RESCUE | ACG | C/5 | R77W | GGCCCCUAGCCGGAUGUG GGAGAUGGGGAAG (SEQ ID NO: 1168) | 5.347 | 1127A |
| NM_004572.3_C-flip_guide | PKP2 | RESCUE | CCG | C/9 | R796C | GUGUGUAACCGGCAGAGG CUGUAGUUUCAAU (SEQ ID NO: 1169) | 20.024 | 127A |
| NM_005609.3_C-flip_guide | PYGM | RESCUE | GCG | C/9 | R798W | GCCGCGUCCCCUCUCUUG GGUUCUUGUACAA (SEQ ID NO: 1170) | 5.946 | 127A |
| NM_005633.3_C-flip_guide | SOS1 | RESCUE | ACG | C/9 | T269M | GCAUCUGUCCUUUCUACU GUAUCUUCUAUAU (SEQ ID NO: 1171) | 39.582 | 127A |
| NM_014139.2_C-flip_guide | SCN11A | RESCUE | CCG | C/9 | P396L | GCAACAGCCCGGGUUAAG UUAAUCAGGUAGA (SEQ ID NO: 1172) | 32.565 | 127A |
| NM_014874.3_C-flip_guide | MFN2 | RESCUE | CCG | C/9 | P76L | GCAACAGCCCGGGUUAAG UUAAUCAGGUAGA (SEQ ID NO: 1173) | 20.769 | 127A |
| NM_015559.2_C-flip_guide | SETBP1 | RESCUE | ACU | C/7 | T871I | GGUCCCACUGCCGCUGUC GCUGGGGAUCGUC (SEQ ID NO: 1174) | 20.136 | 127A |
| NM_020630.4_C-flip_guide | RET | RESCUE | CCG | C/5 | R620C | GUCGCCGAAGCACUUCUC CUCCUCAGGGAAG (SEQ ID NO: 1175) | 15.762 | 127A |

TABLE 31-continued

Guide sequences used for synthetic target editing

| Name | Targeted gene | REPAIR/ RESCUE | Motif | Base flip/ position | Codon change | Spacer sequence | Editing percentage (first figure) | First figure |
|---|---|---|---|---|---|---|---|---|
| NM_000016.5_F_30bp_C-flip_guide_30_5 | ACADM | RESCUE | ACA | C/5 | H67Y | GUCAUCUUCUGCAGCCACUGGGAUGAUUUCC (SEQ ID NO: 1176) | 2.900 | 127B |
| NM_000016.5_F_30bp_C-flip_guide_30_7 | ACADM | RESCUE | ACA | C/7 | H67Y | GUAUCAUCUUCUGCAGCCACUGGGAUGAUUU (SEQ ID NO: 1177) | 7.500 | 127B |
| NM_000016.5_F_30bp_C-flip_guide_30_9 | ACADM | RESCUE | ACA | C/9 | H67Y | GUUUAUCAUCUUCUGCAGCCACUGGGAUGAU (SEQ ID NO: 1178) | 6.477 | 127B |
| NM_000018.3_F_30bp_C-flip_guide_30_5 | ACADVL | RESCUE | GCG | C/5 | A283V | GCACCCCAAAAGCUGUGAUCUUCUCCUUCAC (SEQ ID NO: 1178) | 4.474 | 127B |
| NM_000018.3_F_30bp_C-flip_guide_30_7 | ACADVL | RESCUE | GCG | C/7 | A283V | GUCCACCCCAAAAGCUGUGAUCUUCUCCUUC (SEQ ID NO: 1179) | 5.357 | 127B |
| NM_000018.3_F_30bp_C-flip_guide_30_9 | ACADVL | RESCUE | GCG | C/9 | A283V | GUCUCCACCCCAAAAGCUGUGAUCUUCUCCU (SEQ ID NO: 1180) | 6.274 | 127B |
| NM_000071.2_F_30bp_C-flip_guide_30_5 | CBS | RESCUE | GCG | C/5 | R109C | GUCACCCUUGGCCAAGAGCUCACACUUCAGG (SEQ ID NO: 1181) | 1.269 | 127B |
| NM_000071.2_F_30bp_C-flip_guide_30_7 | CBS | RESCUE | GCG | C/7 | R109C | GACUCACCCUUGGCCAAGAGCUCACACUUCA (SEQ ID NO: 1182) | 2.346 | 127B |
| NM_000071.2_F_30bp_C-flip_guide_30_9 | CBS | RESCUE | GCG | C/9 | R109C | GGAACUCACCCUUGGCCAAGAGCUCACACUU (SEQ ID NO: 1183) | 6.140 | 127B |
| NM_000138.4_F_30bp_C-flip_guide_30_5 | FBN1 | RESCUE | GCG | C/5 | R1408C | GGAGCCCUCAUCAAGGUCUGUACAAGUGAAG (SEQ ID NO: 1184) | 13.751 | 127B |
| NM_000138.4_F_30bp_C-flip_guide_30_7 | FBN1 | RESCUE | GCG | C/7 | R1408C | GCAGAGCCCUCAUCAAGGUCUGUACAAGUGA (SEQ ID NO: 1185) | 12.998 | 127B |
| NM_000138.4_F_30bp_C-flip_guide_30_9 | FBN1 | RESCUE | GCG | C/9 | R1408C | GCUCAGAGCCCUCAUCAAGGUCUGUACAAGU (SEQ ID NO: 1186) | 10.845 | 127B |
| NM_000141.4_F_30bp_C-flip_guide_30_5 | FGFR2 | RESCUE | CCC | C/5 | P267S | GGUGGCGGCAUUUGCCGGCAGUCCGGCUUGG (SEQ ID NO: 1187) | 5.882 | 127B |
| NM_000141.4_F_30bp_C-flip_guide_30_7 | FGFR2 | RESCUE | CCC | C/7 | P267S | GCUGUGGCGGCAUUUGCCGGCAGUCCGGCUU (SEQ ID NO: 1188) | 16.131 | 127B |
| NM_000141.4_F_30bp_C-flip_guide_30_9 | FGFR2 | RESCUE | CCC | C/9 | P267S | GCACUGUGGCGGCAUUUGCCGGCAGUCCGGC (SEQ ID NO: 1189) | 13.994 | 127B |
| NM_000152.4_F_30bp_C-flip_guide_30_5 | GAA | RESCUE | CCC | C/5 | P552L | GCUGGCGGGUCCCCCCAACCACCCCAGGCAC (SEQ ID NO: 1190) | 2.316 | 127B |
| NM_000152.4_F_30bp_C-flip_guide_30_7 | GAA | RESCUE | CCC | C/7 | P552L | GGCCUGGCGGGUCCCCCCAACCACCCCAGGC (SEQ ID NO: 1191) | 2.644 | 127B |
| NM_000152.4_F_30bp_C-flip_guide_30_9 | GAA | RESCUE | CCC | C/9 | P552L | GCCGCCUGGCGGGUCCCCCCAACCACCCCAG (SEQ ID NO: 1192) | 0.168 | 127B |

TABLE 31-continued

| Guide sequences used for synthetic target editing | | | | | | | | |
|---|---|---|---|---|---|---|---|---|
| Name | Target-ed gene | REPAIR/ RESCUE | Motif | Base flip/ posi-tion | Codon change | Spacer sequence | Editing percent-age (first figure) | First figure |
| NM_000341.3 F_30bp_C-flip_guide_30_5 | SLC3A1 | RESCUE | ACG | C/5 | T467M | GAAGCCUGUUCAUCACGU UGACAUACUGAUU (SEQ ID NO: 1193) | 26.164 | 127B |
| NM_000341.3 F_30bp_C-flip_guide_30_7 | SLC3A1 | RESCUE | ACG | C/7 | T467M | GAGAAGCCUGUUCAUCAC GUUGACAUACUGA (SEQ ID NO: 1194) | 28.198 | 127B |
| NM_000341.3_F_30bp_C-flip_guide_30_9 | SLC3A1 | RESCUE | ACG | C/9 | T467M | GAAAGAAGCCUGUUCAUC ACGUUGACAUACU (SEQ ID NO: 1195) | 24.276 | 127B |
| NM_000375.2_F_30bp_C-flip_guide_30_5 | UROS | RESCUE | ACG | C/5 | R73C | GAAACCUAACUCUGCUGC UUCCACUGCUCUG (SEQ ID NO: 1196) | 8.539 | 127B |
| NM_000375.2_F_30bp_C-flip_guide_30_7 | UROS | RESCUE | ACG | C/7 | R73C | GCCAAACCUAACUCUGCU GCUUCCACUGCUC (SEQ ID NO: 1197) | 7.367 | 127B |
| NM_000375.2_F_30bp_C-flip_guide_30_9 | UROS | RESCUE | ACG | C/9 | R73C | GCUCCAAACCUAACUCUG CUGCUUCCACUGC (SEQ ID NO: 1198) | 13.632 | 127B |
| NM_000431.3 F_30bp_C-flip_guide_30_5 | MVK | RESCUE | ACA | C/5 | T268I | GAUCUCUUGAGGUCAGGA GGGGGGCCACGAU (SEQ ID NO: 1199) | 2.858 | 127B |
| NM_000431.3_F_30bp_C-flip_guide_30_7 | MVK | RESCUE | ACA | C/7 | T268I | GGCAUCUCUUGAGGUCAG GAGGGGGGCCACG (SEQ ID NO: 1200) | 13.008 | 127B |
| NM_000431.3_F_30bp_C-flip_guide_30_9 | MVK | RESCUE | ACA | C/9 | T268I | GUGGCAUCUCUUGAGGUC AGGAGGGGGGCCA (SEQ ID NO: 1201) | 13.775 | 127B |
| NM_000551.3_F_30bp_C-flip_guide_30_5 | VHL | RESCUE | CCG | C/5 | P158L | GUUUCCGAGUAUACACUG GCAGUGUGAUAUU (SEQ ID NO: 1202) | 21.328 | 127B |
| NM_000551.3_F_30bp_C-flip_guide_30_7 | VHL | RESCUE | CCG | C/7 | P158L | GUCUUUCCGAGUAUACAC UGGCAGUGUGAUA (SEQ ID NO: 1203) | 22.466 | 127B |
| NM_000551.3_F_30bp_C-flip_guide_30_9 | VHL | RESCUE | CCG | C/9 | P158L | GGCUCUUUCCGAGUAUAC ACUGGCAGUGUGA (SEQ ID NO: 1204) | 20.534 | 127B |
| NM_001256850.1_F_30bp_C-flip_guide_30_5 | TTN | RESCUE | ACG | C/5 | R30071C | GCCACCUGGGCCAGGGGA AUCAAGCACUUUG (SEQ ID NO: 1205) | 6.388 | 127B |
| NM_001256850.1_F_30bp_C-flip_guide_30_7 | TTN | RESCUE | ACG | C/7 | R30071C | GUUCCACCUGGGCCAGGG GAAUCAAGCACUU (SEQ ID NO: 1206) | 13.115 | 127B |
| NM_001256850.1_F_30bp_C-flip_guide_30_9 | TTN | RESCUE | ACG | C/9 | R30071C | GCUUUCCACCUGGGCCAG GGGAAUCAAGCAC (SEQ ID NO: 1207) | 23.207 | 127B |
| NM_002397.4_F_30bp_C-flip_guide_30_5 | MEF2C | RESCUE | ACG | C/5 | T1M | GCCCCCUAGUCCCCGUUU UUCUUCUCUCUCU (SEQ ID NO: 1208) | 0.769 | 127B |
| NM_002397.4_F_30bp_C-flip_guide_30_7 | MEF2C | RESCUE | ACG | C/7 | T1M | GCUCCCCCUAGUCCCCGU UUUUCUUCUCUCU (SEQ ID NO: 1209) | 1.270 | 127B |
| NM_002397.4_F_30bp_C-flip_guide_30_9 | MEF2C | RESCUE | ACG | C/9 | T1M | GUUCUCCCCCUAGUCCCC GUUUUUCUUCUCU (SEQ ID NO: 1210) | 2.313 | 127B |

TABLE 31-continued

Guide sequences used for synthetic target editing

| Name | Targeted gene | REPAIR/ RESCUE | Motif | Base flip/ position | Codon change | Spacer sequence | Editing percentage (first figure) | First figure |
|---|---|---|---|---|---|---|---|---|
| NM_002474.2_F_30bp_C-flip_guide_30_5 | MYH11 | RESCUE | CCG | C/5 | P1264L | GCUGCCGCUCCUGCACCU GCGCCUCCAGCUU (SEQ ID NO: 1211) | 18.278 | 127B |
| NM_002474.2_F_30bp_C-flip_guide_30_7 | MYH11 | RESCUE | CCG | C/7 | P1264L | GGACUGCCGCUCCUGCAC CUGCGCCUCCAGC (SEQ ID NO: 1212) | 25.663 | 127B |
| NM_002474.2_F_30bp_C-flip_guide_30_9 | MYH11 | RESCUE | CCG | C/9 | P1264L | GUGGACUGCCGCUCCUGC ACCUGCGCCUCCA (SEQ ID NO: 1213) | 34.770 | 127B |
| NM_002834.4_F_30bp_C-flip_guide_30_5 | PTPN11 | RESCUE | CCU | C/5 | L285F | GUCAACGGGCAGGAUGUU UUUAUAUCUAUUU (SEQ ID NO: 1214) | 0.520 | 127B |
| NM_002834.4_F_30bp_C-flip_guide_30_7 | PTPN11 | RESCUE | CCU | C/7 | L285F | GGAUCAACGGGCAGGAUG UUUUUAUAUCUAU (SEQ ID NO: 1215) | 0.562 | 127B |
| NM_002834.4_F_30bp_C-flip_guide_30_9 | PTPN11 | RESCUE | CCU | C/9 | L285F | GAUGAUCAACGGGCAGGA UGUUUUUAUAUCU (SEQ ID NO: 1216) | 0.711 | 127B |
| NM_004004.5_F_30bp_C-flip_guide_30_5 | GJB2 | RESCUE | ACG | C/5 | R77W | GGCCCCUAGCCGGAUGUG GGAGAUGGGGAAG (SEQ ID NO: 1217) | 5.347 | 127B |
| NM_004004.5_F_30bp_C-flip_guide_30_7 | GJB2 | RESCUE | ACG | C/7 | R77W | GGGGCCCCUAGCCGGAUG UGGGAGAUGGGGA (SEQ ID NO: 1218) | 4.763 | 127B |
| NM_004004.5_F_30bp_C-flip_guide_30_9 | GJB2 | RESCUE | ACG | C/9 | R77W | GCAGGGCCCCUAGCCGGA UGUGGGAGAUGGG (SEQ ID NO: 1219) | 5.188 | 127B |
| NM_004572.3_F_30bp_C-flip_guide_30_5 | PKP2 | RESCUE | CCG | C/5 | R796C | GUAACCGGCAGAGGCUGU AGUUUCAAUGAGA (SEQ ID NO: 1220) | 12.583 | 127B |
| NM_004572.3_F_30bp_C-flip_guide_30_7 | PKP2 | RESCUE | CCG | C/7 | R796C | GUGUAACCGGCAGAGGCU GUAGUUUCAAUGA (SEQ ID NO: 1221) | 13.950 | 127B |
| NM_004572.3_F_30bp_C-flip_guide_30_9 | PKP2 | RESCUE | CCG | C/9 | R796C | GUGUGUAACCGGCAGAGG CUGUAGUUUCAAU (SEQ ID NO: 1222) | 20.024 | 127B |
| NM_005609.3_F_30bp_C-flip_guide_30_5 | PYGM | RESCUE | GCG | C/5 | R798W | GGUCCCCUCUCUUGGGUU CUUGUACAAGGCG (SEQ ID NO: 1223) | 4.495 | 127B |
| NM_005609.3_F_30bp_C-flip_guide_30_7 | PYGM | RESCUE | GCG | C/7 | R798W | GGCGUCCCCUCUCUUGGG UUCUUGUACAAGG (SEQ ID NO: 1224) | 2.128 | 127B |
| NM_005609.3_F_30bp_C-flip_guide_30_9 | PYGM | RESCUE | GCG | C/9 | R798W | GCCGCGUCCCCUCUCUUG GGUUCUUGUACAA (SEQ ID NO: 1225) | 5.946 | 127B |
| NM_005633.3_F_30bp_C-flip_guide_30_5 | SOS1 | RESCUE | ACG | C/5 | T269M | GUGUCCUUUCUACUGUAU CUUCUAUAUGGCC (SEQ ID NO: 1226) | 12.149 | 127B |
| NM_005633.3_F_30bp_C-flip_guide_30_7 | SOS1 | RESCUE | ACG | C/7 | T269M | GUCUGUCCUUUCUACUGU AUCUUCUAUAUGG (SEQ ID NO: 1227) | 36.068 | 127B |
| NM_005633.3_F_30bp_C-flip_guide_30_9 | SOS1 | RESCUE | ACG | C/9 | T269M | GCAUCUGUCCUUUCUACU GUAUCUUCUAUAU (SEQ ID NO: 1228) | 39.582 | 127B |

TABLE 31-continued

| Name | Targeted gene | REPAIR/ RESCUE | Motif | Base flip/ position | Codon change | Spacer sequence | Editing percentage (first figure) | First figure |
|---|---|---|---|---|---|---|---|---|
| Guide sequences used for synthetic target editing | | | | | | | | |
| NM_014139.2_F_30bp_C-flip_guide_30_5 | SCN11A | RESCUE | CCG | C/5 | P396L | GAGCCCGGGUUAAGUUAAUCAGGUAGAAGGA (SEQ ID NO: 1229) | 22.989 | 127B |
| NM_014139.2_F_30bp_C-flip_guide_30_7 | SCN11A | RESCUE | CCG | C/7 | P396L | GACAGCCCGGGUUAAGUUAAUCAGGUAGAAG (SEQ ID NO: 1230) | 16.783 | 127B |
| NM_014139.2_F_30bp_C-flip_guide_30_9 | SCN11A | RESCUE | CCG | C/9 | P396L | GCAACAGCCCGGGUUAAGUUAAUCAGGUAGA (SEQ ID NO: 1231) | 32.565 | 127B |
| NM_014874.3_F_30bp_C-flip_guide_30_5 | MFN2 | RESCUE | CCG | C/5 | P76L | GGUCCCGAACCUGUUCUUCUGUGGUAACGGG (SEQ ID NO: 1232) | 7.822 | 127B |
| NM_014874.3_F_30bp_C-flip_guide_30_7 | MFN2 | RESCUE | CCG | C/7 | P76L | GACGUCCCGAACCUGUUCUUCUGUGGUAACG (SEQ ID NO: 1233) | 9.585 | 127B |
| NM_014874.3_F_30bp_C-flip_guide_30_9 | MFN2 | RESCUE | CCG | C/9 | P76L | GUGACGUCCCGAACCUGUUCUUCUGUGGUAA (SEQ ID NO: 1234) | 20.769 | 127B |
| NM_015559.2_F_30bp_C-flip_guide_30_5 | SETBP1 | RESCUE | ACU | C/5 | T871I | GCCCACUGCCGCUGUCGCUGGGGAUCGUCUC (SEQ ID NO: 1235) | 4.665 | 127B |
| NM_015559.2_F_30bp_C-flip_guide_30_7 | SETBP1 | RESCUE | ACU | C/7 | T871I | GGUCCCACUGCCGCUGUCGCUGGGGAUCGUC (SEQ ID NO: 1236) | 20.136 | 127B |
| NM_015559.2_F_30bp_C-flip_guide_30_9 | SETBP1 | RESCUE | ACU | C/9 | T871I | GCUGUCCCACUGCCGCUGUCGCUGGGGAUCG (SEQ ID NO: 1237) | 9.130 | 127B |
| NM_020630.4_F_30bp_C-flip_guide_30_5 | RET | RESCUE | CCG | C/5 | R620C | GUCGCCGAAGCACUUCUCCUCCUCAGGGAAG (SEQ ID NO: 1238) | 15.762 | 127B |
| NM_020630.4_F_30bp_C-flip_guide_30_7 | RET | RESCUE | CCG | C/7 | R620C | GGCUCGCCGAAGCACUUCUCCUCCUCAGGGA (SEQ ID NO: 1239) | 12.758 | 127B |
| NM_020630.4_F_30bp_C-flip_guide_30_9 | RET | RESCUE | CCG | C/9 | R620C | GGGGCUCGCCGAAGCACUUCUCCUCCUCAGG (SEQ ID NO: 1240) | 15.652 | 127B |
| ApoE4 rs429358 C flip 30 | APOE | RESCUE | GCG | C/30 | C130R | gccacguccuccauguccgcgcccagccggg (SEQ ID NO: 1241) | 0.040 | 128 |
| ApoE4 rs429358 C flip 28 | APOE | RESCUE | GCG | C/28 | C130R | ggcccacguccuccauguccgcgcccagccg (SEQ ID NO: 1242) | 0.199 | 128 |
| ApoE4 rs429358 C flip 26 | APOE | RESCUE | GCG | C/26 | C130R | gccgcccacguccuccauguccgcgcccagc (SEQ ID NO: 1243) | 0.534 | 128 |
| ApoE4 rs429358 C flip 24 | APOE | RESCUE | GCG | C/24 | C130R | gggccgcccacguccuccauguccgcgccca (SEQ ID NO: 1244) | 0.601 | 128 |
| ApoE4 rs429358 C flip 22 | APOE | RESCUE | GCG | C/22 | C130R | ggcggccgcccacguccuccauguccgcgcc (SEQ ID NO: 1245) | 0.305 | 128 |
| ApoE4 rs429358 C flip 20 | APOE | RESCUE | GCG | C/20 | C130R | gaggcggccgcccacguccuccauguccgcg (SEQ ID NO: 1246) | 0.251 | 128 |

TABLE 31-continued

Guide sequences used for synthetic target editing

| Name | Targeted gene | REPAIR/ RESCUE | Motif | Base flip/ position | Codon change | Spacer sequence | Editing percentage (first figure) | First figure |
|---|---|---|---|---|---|---|---|---|
| ApoE4 rs429358 C flip 18 | APOE | RESCUE | GCG | C/18 | C130R | gccaggcggccgcccacg uccuccauguccg (SEQ ID NO: 1247) | 0.098 | 128 |
| ApoE4 rs429358 C flip 16 | APOE | RESCUE | GCG | C/16 | C130R | gcaccaggcggccgccca cguccuccauguc (SEQ ID NO: 1248) | 0.066 | 128 |
| ApoE4 rs429358 U flip 30 | APOE | RESCUE | GCG | U/30 | C130R | gucacguccuccauguccgcgcccagccggg (SEQ ID NO: 1249) | 0.037 | 128 |
| ApoE4 rs429358 U flip 28 | APOE | RESCUE | GCG | U/28 | C130R | ggcucacguccuccaugu ccgcgcccagccg (SEQ ID NO: 1250) | 0.831 | 128 |
| ApoE4 rs429358 U flip 26 | APOE | RESCUE | GCG | U/26 | C130R | gccgcucacguccuccau guccgcgcccagc (SEQ ID NO: 1251) | 0.787 | 128 |
| ApoE4 rs429358 U flip 24 | APOE | RESCUE | GCG | U/24 | C130R | gggccgcucacguccucc auguccgcgccca (SEQ ID NO: 1252) | 5.382 | 128 |
| ApoE4 rs429358 U flip 22 | APOE | RESCUE | GCG | U/22 | C130R | ggcggccgcucacguccu ccauguccgcgcc (SEQ ID NO: 1253) | 0.913 | 128 |
| ApoE4 rs429358 U flip 20 | APOE | RESCUE | GCG | U/20 | C130R | gaggcggccgcucacguc cuccauguccgcg (SEQ ID NO: 1254) | 0.654 | 128 |
| ApoE4 rs429358 U flip 18 | APOE | RESCUE | GCG | U/18 | C130R | gccaggcggccgcucacg uccuccauguccg (SEQ ID NO: 1255) | 0.281 | 128 |
| ApoE4 rs429358 U flip 16 | APOE | RESCUE | GCG | U/16 | C130R | gcaccaggcggccgcuca cguccuccauguc (SEQ ID NO: 1256) | 0.236 | 128 |
| ApoE4 rs7412 C flip 30 | APOE | RESCUE | GCG | C/30 | C176R | gccuucugcaggucaucg gcaucgcggagga (SEQ ID NO: 1257) | 0.079 | 128 |
| ApoE4 rs7412 C flip 28 | APOE | RESCUE | GCG | C/28 | C176R | ggcccuucugcaggucau cggcaucgcggag (SEQ ID NO: 1258) | 2.900 | 128 |
| ApoE4 rs7412 C flip 26 | APOE | RESCUE | GCG | C/26 | C176R | gaggcccuucugcagguc aucggcaucgcgg (SEQ ID NO: 1259) | 0.908 | 128 |
| ApoE4 rs7412 C flip 24 | APOE | RESCUE | GCG | C/24 | C176R | gccaggcccuucugcagg ucaucggcaucgc (SEQ ID NO: 1260) | 2.397 | 128 |
| ApoE4 rs7412 C flip 22 | APOE | RESCUE | GCG | C/22 | C176R | gugccaggcccuucugca ggucaucggcauc (SEQ ID NO: 1261) | 3.436 | 128 |
| ApoE4 rs7412 C flip 20 | APOE | RESCUE | GCG | C/20 | C176R | gacugccaggcccuucug caggucaucggca (SEQ ID NO: 1262) | 5.725 | 128 |
| ApoE4 rs7412 C flip 18 | APOE | RESCUE | GCG | C/18 | C176R | gacacugccaggcccuuc ugcaggucaucgg (SEQ ID NO: 1263) | 2.987 | 128 |
| ApoE4 rs7412 C flip 16 | APOE | RESCUE | GCG | C/16 | C176R | gguacacugccaggcccu ucugcaggucauc (SEQ ID NO: 1264) | 0.407 | 128 |

TABLE 31-continued

Guide sequences used for synthetic target editing

| Name | Targeted gene | REPAIR/ RESCUE | Motif | Base flip/ position | Codon change | Spacer sequence | Editing percentage (first figure) | First figure |
|---|---|---|---|---|---|---|---|---|
| ApoE4 rs7412 U flip 30 | APOE | RESCUE | GCG | U/30 | C176R | gucuucugcaggucaucg gcaucgcggagga (SEQ ID NO: 1265) | 0.125 | 128 |
| ApoE4 rs7412 U flip 28 | APOE | RESCUE | GCG | U/28 | C176R | ggcucuucugcaggucau cggcaucgcggag (SEQ ID NO: 1266) | 3.633 | 128 |
| ApoE4 rs7412 U flip 26 | APOE | RESCUE | GCG | U/26 | C176R | gaggcucuucugcagguc aucggcaucgcgg (SEQ ID NO: 1267) | 1.087 | 128 |
| ApoE4 rs7412 U flip 24 | APOE | RESCUE | GCG | U/24 | C176R | gccaggcucuucugcagg ucaucggcaucgc (SEQ ID NO: 1268) | 3.305 | 128 |
| ApoE4 rs7412 U flip 22 | APOE | RESCUE | GCG | U/22 | C176R | gugccaggcucuucugca ggucaucggcauc (SEQ ID NO: 1269) | 6.810 | 128 |
| ApoE4 rs7412 U flip 20 | APOE | RESCUE | GCG | U/20 | C176R | gacugccaggcucuucug caggucaucggca (SEQ ID NO: 1270) | 10.902 | 128 |
| ApoE4 rs7412 U flip 18 | APOE | RESCUE | GCG | U/18 | C176R | gacacugccaggcucuuc ugcaggucaucgg (SEQ ID NO: 1271) | 9.357 | 128 |
| ApoE4 rs7412 U flip 16 | APOE | RESCUE | GCG | U/16 | C176R | gguacacugccaggcucu ucugcaggucauc (SEQ ID NO: 1272) | 0.643 | 128 |

TABLE 32

Mammalian plasmids and maps

| Plasmid | Description | Benchling link |
|---|---|---|
| pC0043 | PspCas13b crRNA backbone | benchling.com/s/s eq-OH6nMnZCZn930BWqcFNa |
| pC0076 | CMV-dRanCas13b-mapkNES-GS-dADAR2 E488Q | benchling.com/s/s eq-BulRvsrtwP4aEJtTqYM2 |
| pC0077 | pCMV-dRanCas13b-mapkNES-GS-dADAR2(E488Q/V351G/S486A/T375S/S370C/P462A/N597I/L332I/I398V) r8 | benchling.com/s/s eq-gQ13PMPLkcO6OceAfmpC |
| pC0078 | pCMV-dRanCas13b-mapkNES-GS-dADAR2(E488Q/V351G/S486A/T375S/S370C/P462A/N597I/L332I/I398V/K350I/M383L/D619G/S582T/V440I/S495N/K418E/S661T) r16 | benchling.com/s/s eq-19Ytwwh0o0vSlbyXYZ95 |
| pC0079 | pCMV-dRanCas13b-mapkNES-GS-dADAR2(E488Q/V351G/S486A/T375A/S370C/P462A/N597I/L332I/I398V/K350I/M383L/D619G/S582T/V440I/S495N/K418E/S661T) RESCUE-S | benchling.com/s/s eq-WX6VnavLS6JaaZ54XAOx |
| pC0080 | pCMV-dCas13b12-HIVNES-GS-dADAR2(E488Q/V351G/S486A/T375S/S370C/P462A/N597I/L332I/I398V/K350I/M383L/D619G/S582T/V440I/S495N/K418E/S661T) RESCUE | benchling.com/s/s eq-GQqPCRE9I6KnEfHksQem |
| pC0081 | pCMV-dCas13b12-HIVNES-GS-dADAR2(E488Q/V351G/S486A/T375S/S370C/P462A/N597I/L332I/I398V/K350I/M383L/D619G/S582T/V440I/S495N/K418E/S661T/S375A) RESCUE-S | benchling.com/s/s eq-qjbEAXZgupeRXBa8abls |
| pC0082 | CMV-Cluciferase-polyA EF1a-G-luciferase(C82R)-polyA C to U reporter TCG motif | benchling.com/s/s eq-Qjsg3Yx0r1Hs77GT58BI |
| pC0083 | CMV-Cluciferase-polyA EF1a-G-luciferase(C82R)-polyA C to U reporter GCG motif | benchling.com/s/s eq-Z8zwu3LdetcuYHAFGnpe |
| pC0084 | CMV-Cluciferase-polyA EF1a-G-luciferase(C82R)-polyA C to U reporter ACG motif | benchling.com/s/s eq-G2Iag6I8NBQAXqbJnou5 |
| pC0085 | CMV-Cluciferase-polyA EF1a-G-luciferase(C82R)-polyA C to U reporter CCG motif | benchling.com/s/s eq-alkwhNUsFTg80TVmpquP |
| pC0086 | CMV-Cluciferase-polyA EF1a-G-luciferase(L77P)-polyA C to U reporter CCA motif | benchling.com/s/s eq-1J8Fm6vtF7GZS676Q7p |
| pC0087 | CMV-Cluciferase-polyA EF1a-G-luciferase(L77P)-polyA C to U reporter CCT motif | benchling.com/s/s eq-5MMokwvxoAjq6ML2sjjZ |
| pC0088 | pCMV-ADAR2dd(E488Q/V351G/S486A/T375S/S370C/P462A/N597I/L332I/I398V/K350I/M383L/D619G/S582T/V440I/S495N/K418E/S661T) r16 | benchling.com/s/s eq-YISAybq2YnuclVwYDy95 |

TABLE 32-continued

| Mammalian plasmids and maps | | |
|---|---|---|
| Plasmid | Description | Benchling link |
| pC0089 | pCMV-ADAR2 full length (E488Q/V351G/S486A/T375S/S370C/P462A/N597I/L332I/I398V/K350I/M383L/D619G/S582T/V440I/S495N/K418E/S661T) r16 | benchling.com/s/s eq-95ZpoHj9GhQFzIu3m6cb |
| pC0090 | Beta catenin reporter M50 Super 8x (TCF/LEF binding sites) TOPFlash with Gluc/Cluc | benchling.com/s/s eq-jPxZnxs3wSeKZhgTTDBu |
| pC0091 | Beta catenin reporter control M51 Super 8x (mutated TCF/LEF binding sites) FOPFlash with Gluc/Cluc | benchling.com/s/s eq-130b6c9baCfw8R3lTgs R |

TABLE 33

| Yeast plasmids and maps | |
|---|---|
| Description | Benchling link |
| pGAL-dRanCas13b-GS-dADAR2 [RESCUEr0 Yeast] | benchling.com/s/seq-w1l2aOHR2gSe4P2aQ7VY |
| pGAL-dRanCas13b-GS-dADAR2(V351/S486A/T375S) [RESCUEr3 Yeast] | benchling.com/s/seq-saQngvNf6i3GhSGF0H3I |
| pGAL-dRanCas13b-GS-dADAR2(V351G/S486A/T375S/S370C/P462A/L332I) [RESCUEr7 Yeast] | benchling.com/s/seq-GIJ7BnpV3Vd3XtKiIxdm |
| pYES3/CT pADH1-HH-Targeting-RanCas13b_DR-- HDV-space-ADH1_terminator His (P196L) [Yeast target His P196L] | benchling.com/s/seq-Xs2ffVMn4FwwQ79zDDEo |
| pYES3/CT pADH1-HH-Golden-gate-BsmBi-BsmbI_RanCas13b_DR--HDV-space-ADH1_terminator His (P196L) [Yeast target His P196L NT] | benchling.com/s/seq-UM9NjG7JKK0GFe9MowGo |

TABLE 33-continued

| Yeast plasmids and maps | |
|---|---|
| Description | Benchling link |
| pYES3/CT pADH1-HH-Guide-RanCas13b_DR--HDV-space-ADH1_terminator His S129P [Yeast target His S129P] | benchling.com/s/seq-EefJI5brqll3fm0B5Qc5 |
| pYES3/CT pADH1-HH-Golden-gate-BsmBi-BsmbI_RanCas13b_DR--HDV-space-ADH1_terminator His Motifs S129P [Yeast target His S129P NT] | benchling.com/s/seq-bt7gOlrp8OuOoV3YJWZG |
| pYES3/CT pADH1-HH-Y66H-targeting-RanCas13b-DR-HDV-ADH1-term ATG-yeGFP Y66H [Yeast target GFP Y66H] | benchling.com/s/seq-hiMELqTYPT9y0nOAKEq2 |
| pYES3/CT pADH1-HH-Golden-gate-BsmBi-BsmbI_-RanCas13b_DR-HDV-ADH1-term ATG-yeGFP Y66H Reporter [Yeast target GFP Y66H NT] | benchling.com/s/seq-OCWlvnjeKYwSbG8GELTQ |
| pYES3/CT pADH1-HH-Targeting-RanCas13b_DR-- HDV-space-ADH1_terminator His (S22P) [Yeast target 30/26 His S22P] | benchling.com/s/seq-ziOgQXpXGZwot9NDkFJf |
| pYES3/CT pADH1-HH-Targeting-RanCas13b_DR-- HDV-space-ADH1_terminator His (S22P) [Yeast target 30/24 His S22P] | benchling.com/s/seq-Ni9S7NsmGwWEYQM7K1EF |
| pYES3/CT pADH1-HH-Targeting-RanCas13b_DR-- HDV-space-ADH1_terminator His (S22P) [Yeast target 30/22 His S22P] | benchling.com/s/seq-yW539UdpUtm9kZbLafaJ |
| pYES3/CT pADH1-HH-Targeting-RanCas13b_DR-- HDV-space-ADH1_terminator His (S22P) [Yeast target 30/20 His S22P] | benchling.com/s/seq-z37Sri5Pds8UofSHRtGe |
| pYES3/CT pADH1-HH-Golden-gate-BsmBi-BsmbI_RanCas13b_DR--HDV-space-ADH1_terminator His (S22P) [Yeast target His S22P NT] | benchling.com/s/seq-6HoWi69XrcLL4nW2ya0V |

TABLE 34

| Guide sequences used for yeast targeting | | | | | | |
|---|---|---|---|---|---|---|
| Name | Targeted gene | Motif | Base flip/spacer length/ position | Codon change | Spacer sequence | First figure |
| His Y66H targeting | EGFP | UCA | U/50/34 | Y66H | aaacauugaacaccauuaguuaaaguagugacuaagguuggccauggaac (SEQ ID NO: 1273) | 113A |
| His L196P targeting | HIS | CCU | U/50/34 | L196P | ucuuauggcaaccgcaugagccuugaacgcacucucacuacggugaugau (SEQ ID NO: 1274) | 113C |
| His S129P targeting | HIS | UCC | C/30/26 | S129P | gcuugcaagugccucauccaaaggcgcaaau (SEQ ID NO: 1275) | 113D |
| His S22P targeting 30/26 | HIS | UCC | U/30/26 | S22P | aauguaaucgcaaucugaaucuugguuuca (SEQ ID NO: 1276) | 113E |

TABLE 34-continued

| Guide sequences used for yeast targeting | | | | | | |
|---|---|---|---|---|---|---|
| Name | Targeted gene | Motif | Base flip/spacer length/ position | Codon change | Spacer sequence | First figure |
| His S22P targeting 30/24 | HIS | UCC | U/30/24 | S22P | uuaauguaaucgca aucugaaucuuggu uu (SEQ ID NO: 1277) | 113E |
| His S22P targeting 30/22 | HIS | UCC | U/30/22 | S22P | cuuuaauguaaucg caaucugaaucuug gu (SEQ ID NO: 1278) | 113E |
| His S22P targeting 30/20 | HIS | UCC | U/30/20 | S22P | cccuuuaauguaau cgcaaucugaaucu ug (SEQ ID NO: 1279) | 113E |

REFERENCES

1. O. O. Abudayyeh et al., C2c2 is a single-component programmable RNA-guided RNA-targeting CRISPR effector. *Science* 353, aaf5573 (2016).
2. C. Cassidy-Amstutz et al., Identification of a Minimal Peptide Tag for in Vivo and in Vitro Loading of Encapsulin. *Biochemistry* 55, 3461-3468 (2016).
3. S. Shmakov et al., Discovery and Functional Characterization of Diverse Class2 CRISPR-Cas Systems. *Mol Cell* 60, 385-397 (2015).
4. A. A. Smargon et al., Cas13b Is a Type VI-B CRISPR-Associated RNA-Guided RNase Differentially Regulated by Accessory Proteins Csx27 and Csx28. *Mol Cell* 65, 618-630 e617 (2017).
5. A. East-Seletsky et al., Two distinct RNase activities of CRISPR-C2c2 enable guide-RNA processing and RNA detection. *Nature* 538, 270-273 (2016).
6. O. O. Abudayyeh et al., RNA targeting with CRISPR-Cas13. *Nature* 550, 280-284 (2017).
7. D. B. T. Cox et al., RNA editing with CRISPR-Cas13. *Science* 358, 1019-1027 (2017).
8. T. Merkle et al., Precise RNA editing by recruiting endogenous ADARs with antisense oligonucleotides. *Nat Biotechnol* 37, 133-138 (2019).
9. P. Vogel et al., Efficient and precise editing of endogenous transcripts with SNAP-tagged ADARs. *Nat Methods* 15, 535-538 (2018).
10. M. Fukuda et al., Construction of a guide-RNA for site-directed RNA mutagenesis utilising intracellular A-to-I RNA editing. *Sci Rep* 7, 41478 (2017).
11. J. Wettengel, P. Reautschnig, S. Geisler, P. J. Kahle, T. Stafforst, Harnessing human ADAR2 for RNA repair—Recoding a PINK1 mutation rescues mitophagy. *Nucleic Acids Res* 45, 2797-2808 (2017).
12. M. F. Montiel-Gonzalez, I. C. Vallecillo-Viejo, J. J. Rosenthal, An efficient system for selectively altering genetic information within mRNAs. *Nucleic Acids Res* 44, e157 (2016).
13. P. Vogel, M. F. Schneider, J. Wettengel, T. Stafforst, Improving site-directed RNA editing in vitro and in cell culture by chemical modification of the guideRNA. *Angew Chem Int Ed Engl* 53, 6267-6271 (2014).
14. M. F. Montiel-Gonzalez, I. Vallecillo-Viejo, G. A. Yudowski, J. J. Rosenthal, Correction of mutations within the cystic fibrosis transmembrane conductance regulator by site-directed RNA editing. *Proc Natl Acad Sci USA* 110, 18285-18290 (2013).
15. H. A. Rees, D. R. Liu, Base editing: precision chemistry on the genome and transcriptome of living cells. *Nat Rev Genet* 19, 770-788 (2018).
16. A. C. Komor, Y. B. Kim, M. S. Packer, J. A. Zuris, D. R. Liu, Programmable editing of a target base in genomic DNA without double-stranded DNA cleavage. *Nature* 533, 420-424 (2016).
17. K. Nishida et al., Targeted nucleotide editing using hybrid prokaryotic and vertebrate adaptive immune systems. *Science* 353, (2016).
18. J. D. Salter, R. P. Bennett, H. C. Smith, The APOBEC Protein Family: United by Structure, Divergent in Function. *Trends Biochem Sci* 41, 578-594 (2016).
19. S. Jin et al., Cytosine, but not adenine, base editors induce genome-wide off-target mutations in rice. *Science*, (2019).
20. E. Zuo et al., Cytosine base editor generates substantial off-target single-nucleotide variants in mouse embryos. *Science*, (2019).
21. J. Grunewald et al., Transcriptome-wide off-target RNA editing induced by CRISPR-guided DNA base editors. *Nature*, (2019).
22. M. R. Macbeth et al., Inositol hexakisphosphate is bound in the ADAR2 core and required for RNA editing. *Science* 309, 1534-1539 (2005).
23. M. M. Matthews et al., Structures of human ADAR2 bound to dsRNA reveal base-flipping mechanism and basis for site selectivity. *Nature structural & molecular biology* 23, 426-433 (2016).
24. D. Katrekar et al., In vivo RNA editing of point mutations via RNA-guided adenosine deaminases. *Nat Methods* 16, 239-242 (2019).
25. B. T. MacDonald, K. Tamai, X. He, Wnt/beta-catenin signaling: components, mechanisms, and diseases. *Dev Cell* 17, 9-26 (2009).
26. M. K. Chee, S. B. Haase, New and Redesigned pRS Plasmid Shuttle Vectors for Genetic Manipulation of *Saccharomyces cerevisiae*. G3 (Bethesda) 2, 515-526 (2012).
27. M. F. Laughery et al., New vectors for simple and streamlined CRISPR-Cas9 genome editing in *Saccharomyces cerevisiae*. *Yeast* 32, 711-720 (2015).

28. M. R. Macbeth, B. L. Bass, Large-scale overexpression and purification of ADARs from *Saccharomyces cerevisiae* for biophysical and biochemical studies. *Methods Enzymol* 424, 319-331 (2007).
29. H. Ng, N. Dean, Dramatic Improvement of CRISPR/Cas9 Editing in *Candida albicans* by Increased Single Guide RNA Expression. *mSphere* 2, (2017).
30. R. Heim, D. C. Prasher, R. Y. Tsien, Wavelength mutations and posttranslational autoxidation of green fluorescent protein. *Proc Natl Acad Sci USA* 91, 12501-12504 (1994).
31. Y. Wang, P. A. Beal, Probing RNA recognition by human ADAR2 using a high-throughput mutagenesis method. *Nucleic Acids Res* 44, 9872-9880 (2016).
32. R. D. Gietz, R. H. Schiestl, Large-scale high-efficiency yeast transformation using the LiAc/SS carrier DNA/PEG method. *Nat Protoc* 2, 38-41 (2007).
33. S. B. Kim, H. Suzuki, M. Sato, H. Tao, Superluminescent variants of marine luciferases for bioassays. *Anal Chem* 83, 8732-8740 (2011).
34. M. T. Veeman, D. C. Slusarski, A. Kaykas, S. H. Louie, R. T. Moon, Zebrafish prickle, a modulator of noncanonical Wnt/Fz signaling, regulates gastrulation movements. *Curr Biol* 13, 680-685 (2003).

Various modifications and variations of the described methods, pharmaceutical compositions, and kits of the invention will be apparent to those skilled in the art without departing from the scope and spirit of the invention. Although the invention has been described in connection with specific embodiments, it will be understood that it is capable of further modifications and that the invention as claimed should not be unduly limited to such specific embodiments. Indeed, various modifications of the described modes for carrying out the invention that are obvious to those skilled in the art are intended to be within the scope of the invention. This application is intended to cover any variations, uses, or adaptations of the invention following, in general, the principles of the invention and including such departures from the present disclosure come within known customary practice within the art to which the invention pertains and may be applied to the essential features herein before set forth.

SEQUENCE LISTING (1280 sequences)

SEQ ID NO: 1 - RNA, 42 nt, Prevotella buccae
  source 1..42: mol_type = other RNA
hgccttgttgcatctgccttctttttgaaaggtaaaaacaac

SEQ ID NO: 2 - RNA, 36 nt, Prevotella buccae
  source 1..36: mol_type = other RNA
gttgcatctgccttctttttgaaaggtaaaaacaac

SEQ ID NO: 3 - RNA, 37 nt, Prevotella buccae
  source 1..37: mol_type = other RNA
tgttgcatctgccttctttttgaaaggtaaaaacaac

SEQ ID NO: 4 - RNA, 36 nt, Prevotella buccae; identical to SEQ ID NO: 2
  source 1..36: mol_type = other RNA

SEQ ID NO: 5 - RNA, 36 nt, Prevotella buccae
  source 1..36: mol_type = other RNA
gttgcatctgcctgctgtttgcaaggtaaaaacaac

SEQ ID NO: 6 - RNA, 36 nt, Prevotella buccae
  source 1..36: mol_type = other RNA
gttgggactgctctcactttgaagggtattcacaac

SEQ ID NO: 7 - RNA, 36 nt, Prevotella buccae
  source 1..36: mol_type = other RNA
gttgtatctgccttctgtttgaaaggtaaaaacaac

SEQ ID NO: 8 - RNA, 36 nt, Prevotella buccae
  source 1..36: mol_type = other RNA
gttgtgtctacctcctttttgagaggtaaaaacagc

SEQ ID NO: 9 - RNA, 36 nt, Prevotella buccae
  source 1..36: mol_type = other RNA
gttggatctaccctctatttgaagggtacacacaac

SEQ ID NO: 10 - RNA, 36 nt, Prevotella buccae; identical to SEQ ID NO: 2
  source 1..36: mol_type = other RNA

SEQ ID NO: 11 - RNA, 36 nt, Prevotella buccae
  source 1..36: mol_type = other RNA
caacgtagacggaagaaaaactttccatttttgttg

SEQ ID NO: 12 - protein, 83 aa, Prevotella buccae
PFYDYPFNIGNRLKPKKRQFLDKKERVELWQKNKELFKNYPSEKKKTDLAYLDFLSWKKFERELRLIKNQDIVTWLMFKELFN

SEQ ID NO: 13 - protein, 64 aa, unidentified
  source 1..64: note = Lachnospiraceae bacterium
LNEIINNFNGIRIKTDYHSLLDKKEKERFEARQNWTSIENIKELKAGYISQVVHKICELVEKYD

SEQ ID NO: 14 - protein, 1128 aa, Prevotella buccae
MQKQDKLFVDRKKNAIFAFPKYITIMENKEKPEPIYYELTDKHFWAAFLNLARHNVYTTINHINRRLEIAELKDDGYMMGIKGSWNEQAKKLDKKVRLRDLIMKHFPFLEAAAYEMTNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPLSLYERLREKDRESFKVPFDIFSDDYNAEEEPFKNTLVRHQDRFPYFVLRYFDLNEIFEQLRFQIDLGTYHFSIYNKRIGDEDEVRHLTHHLYGFARIQDFAPQNQPEEWRKLVKDLDHFETSQEPYISKTAPHYHLENEKIGIKFCSAHNNLFPSLQTDKTCNGRSKFNLGTQFTAEAFLSVHELLPMMFYYLLLTKDYSRKESADKVEGIIRKEISNIYAIYDAFANNEINSIADLTRRLQNTNILQGHLPKQMISILKGRQKDMGKEAERKIGEMIDDTQRRLDLLCKQTNQKIRIGKTNAGLLKSGKIADWLVNDMMRFQPVQKKDQNNIPINNSKANSTEYRMLQRALALFGSENFRLKAYFNQMNLVGNDNPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNRLKPKKRQFLDKKERVELWQKNKELFKNYPSEKKKTDLAYLDFLSWKKFERELRLIKNQDIVTWLMFKELFNMATVEGLKIGEIHLRDIDTNTANEESNNILNRIMPMKLPVKTYETDNKGNILKERPLATFYIEETETKVLKQGNFKALVKDRRLNGLFSFAETTDLNLEEHPISKLSVDLELIKYQTTRISIFEMTLGLEKKLIDKYSTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 15 - protein, 1126 aa, Prevotella intermedia
MEDDKKTTDSIRYELKDKHFWAAFLNLARHNVYITVNHINKILEEGEINRDGYETTLKNTWNEIKDINKKDRLSKLIIKHFPFLEAATYRLNPTDTTKQKEEKQAEAQSLESLRKSFFVFIYKLRDLRNHYSHYKHSKSLERPKFEEGLLEKMYNIFNASIRLVKEDYQYNKDINPDEDFKHLDRTEEEFNYYFTKDNEGNITESGLLFFVSLFLEKKDAIWMQQKLRGFKDNRENKKKMTNEVFCRSRMLLPKLRLQSTQTQDWILLDMLNELIRCPKSLYERLREEDREKFRVPIEIADEDYDAEQEPFKNTLVRHQDRFPYFALRYFDLNEIFTNLRFQIDLGTYHFSIYKKQIGDYKESHHLTHKLYGFERIQEFTKQNRPDEWRKFVKTFNSFETSKEPYIPETTPHYHLENQKIGIRFRNDNDKIWPSLKTNSEKNEKSKYKLDKSFQAEAFLSVHELLPMMFYYLLLKTENTDNDNEIETKKKENKNDKQEKHKIEEIIENKITEIYALYDTFANGEIKSIDELEEYCKGKDIEIGHLPKQMIAILKDEHKVMATEAERKQEEMLVDVQKSLESLDNQINEEIENVERKNSSLKSGKIASWLVNDMMRFQPVQKDNEGKPLNNSKANSTEYQLLQRTLAFFGSEHERLAPYFKQTKLIESSNPHPFLKDTEWEKCNNILSFYRSYLEAKKNFLESLKPEDWEKNQYFLKLKEPKTKPKTLVQGWKNGFNLPRGIFTEPIRKWFMKHRENITVAELKRVGLVAKVIPLFFSEEYKDSVQPFYNYHFNVGNINKPDEKNFLNCEERRELLRKKKDEFKKMTDKEKEENPSYLEFKSWNKFERELRLVRNQDICTWLLCMELFNKKKIKELNVEKIYLKNINTNTTKKEKNTEEKNGEEKNIKEKNNILNRIMPMRLPIKVYGRENFSKNKKKKIRRNTFFTVYIEEKGTKLLKQGNFKALERDRRLGGLFSFVKTPSKAESKSNTISKLRVEYELGEYQKARIEIIKDMLALEKTLIDKYNSLDTDNFNKMLTDWLELKGEPDKASFQNDVDLLIAVRNAFSHNQYPMRNRIAFANINPFSLSSANTSEEKGLGIANQLKDKTHKTIEKIIEIEKPIETKE

SEQ ID NO: 16 - protein, 1098 aa, Riemerella anatipestifer
MEKPLLPNVYTLKHKFFWGAFLNIARHNAFITICHINEQLGLKTPSNDDKIVDVVCETWNNILNNDHDLLKKSQLTELILKHFPFLTAMCYHPPKKEGKKKGHQKEQQKEKESEAQSQAEALNPSKLIEALEILVNQLHSLRNYYSHYKHKKPDAEKDIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLLGTSKELYPSLLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSEDLMLSKPIRKEIKKHGRVGFISRAITLYFKEKYQDKHQSFYNLSYKLEAKAPLLKREEHYEYWQQNKPQSPTESQRLELHTSDRWKDYLLYKRWQHLEKKLRLYRNQDVMLWLMTLELTKNHFKELNLNYHQQLKLENLAVNVQESDAKLNPLNQTLPMVLPVKVYPATAFGEVQYHKTPIRTVYIREEHTKALKMGNFKALVKDRRLNGLFSFIKEENDTQKHPISQLRLRRELEIYQSLRVDAFKETLSLEEKLLNKHTSLSSLENEFRALLEEWKKEYAASSMVTDEHIAFIASVRNAFCHNQYPFYKEALHAPIPLFTVAQPTTEEKDGLGIAEALLKVLREYCEIVKSQI

SEQ ID NO: 17 - protein, 1124 aa, unidentified
  source 1..1124: note = Prevotella aurantiaca
MEDDKKTTGSISYELKDKHFWAAFLNLARHNVYITINHINKLLEIREIDNDEKVLDIKTLWQKGNKDLNQKARLRELMTKHFPFLETAIYTKNKEDKKEVKQEKQAEAQSLESLKDCLFLFLDKLQEARNYYSHYKYSEFSKEPEFEEGLLEKMYNIFGNNIQLVINDYQHNKDINPDEDFKHLDRKGQFKYSFADNEGNITESGLLFFVSLFLEKKDAIWMQQKLNGFKDNLENKKKMTHEVFCRSRILMPKLRLESTQTQDWILLDMLNELIRCPKSLYERLQGDDREKFKVPFDPADEDYNAEQEPFNKTLIRHQDRFPYFVLRYFDYNEIFKNLRFQIDLGTYHFSIYKKLIGGQKEDRHLTHKLYGFERIQEFAKQNRPDEWKAIVKDLDTYETSNKRYISETTPHYHLENQKIGIRFRNGNKEIWPSLKTNDENNEKSKYKLDKQYQAEAFLSVHELLPMMFYYLLLKKEKPNNDEINASIVEGFIKREIRNIFKLYDAFANGEINNIDDLEKYCADKGIPKRHLPKQMVAILYDEHKDMVKEAKRKQKEMVKDTKKLLATLEKQTQKEKEDDGRNVKLLKSGEIARWLVNDMMRFQPVQKDNEGKPLNNSKANSTEYQMLQRSLALYNNEEKPTRYFRQVNLIESNNPHPFLKWTKWEECNNILTFYYSYLTKKIEFLNKLKPEDWKKNQYFLKLKEPKTNRETLVQGWKNGFNLPRGIFTEPIREWFKRHQNNSKEYEKVEALDRVGLVTKVIPLFFKEEYFKDKEENFKEDTQKEINDCVQPFYNFPYNVGNIHKPKEKDFLHREERIELWDKKKDKFKGYKEKIKSKKLTEKDKKFRSYLEFQSWNKFERELRLVRNQDIVTWLLCKELIDKLKIDELNIEELKKLRLNNIDTDTTAKKEKNNILNRVMPMELPVTVYEIDDSHKIVKDKPLHTIYIKEAETKLLKQGNFKALVKDRRLNGLFSFVKTNSEAESKRNPISKLRVEYELGEYQEARIEIIQDMLALEEKLINKYKDLPTNKFSEMLNSWLEGKDEADKARFQNDVDFLIAVRNAFSHNQYPMHNKIEFANIKPFSLYTANNSEEKGLGIANQLKDKTKETTDKIKKIEKPIETKE

SEQ ID NO: 18 - protein, 1151 aa, unidentified
  source 1..1151: note = Prevotella saccharolytica
MEDKPFWAAFFNLARHNVYLTVNHINKLLDLEKLYDEGKHKEIFEREDIFNISDDVMNDANSNGKKRKLDIKKIWDDLDTDLTRKYQLRELILKHFPFIQPAIIGAQTKERTTIDKDKRSTSTSNDSLKQTGEGDINDLLSLSNVKSMFFRLLQILEQLRNYYSHVKHSKSATMPNFDEDLLNWMRYIFIDSVNKVKEDYSSNSVIDPNTSFSHLIYKDEQGKIKPCRYPFTSKDGSINAFGLLFFVSLFLEKQDSIWMQKKIPGFKKASENYMKMTNEVFCRNHILLPKIRLETVYDKDWMLLDMLNEVVRCPLSLYKRLTPAAQNKFKVPEKSSDNANRQEDDNPFSRILVRHQNRFPYFVLRFFDLNEVFTTLRFQINLGCYHFAICKKQIGDKKEVHHLIRTLYGFSRLQNFTQNTRPEEWNTLVKTTEPSSGNDGKTVQGVPLPYISYTIPHYQIENEKIGIKIFDGDTAVDTDIWPSVSTEKQLNKPDKYTLTPGFKADVFLSVHELLPMMFYYQLLLCEGMLKTDAGNAVEKVLIDTRNAIFNLYDAFVQEKINTITDLENYLQDKPILIGHLPKQMIDLLKGHQRDMLKAVEQKKAMLIKDTERRLKLLDKQLKQETDVAAKNTGTLLKNGQIADWLVNDMMRFQPVKRDKEGNPINCSKANSTEYQMLQRAFAFYATDSCRLSRYFTQLHLIHSDNSHLFLSRFEYDKQPNLIAFYAAYLKAKLEFLNELQPQNWASDNYFLLLRAPKNDRQKLAEGWKNGFNLPRGLFTEKIKTWFNEHKTIVDISDCDIFKNRVGQVARLIPVFFDKKFKDHSQPFYRYDFNVGNVSKPTEANYLSKGKREELFKSYQNKFKNNIPAEKTKEYREYKNFSLWKKFERELRLIKNQDILIWLMCKNLFDEKIKPKKDILEPRIAVSYIKLDSLQTNTSTAGSLNALAKVVPMTLAIHIDSPKPKGKAGNNEKENKEFTVYIKEEGTKLLKWGNFKTLLADRRIKGLFSYIEHDDIDLKQHPLTKRRVDLELDLYQTCRIDIFQQTLGLEAQLLDKYSDLNTDNFYQMLIGWRKKEGIPRNIKEDTDFLKDVRNAFSHNQYPDSKKIAFRRIRKFNPKEPILEEEEGLGIATQMYKEVEKVVNRIKRIELFD

SEQ ID NO: 19 - protein, 1120 aa, Prevotella intermedia
MEDDKKTTDSIRYELKDKHFWAAFLNLARHNVYITVNHINKILEEDEINRDGYENTLENSWNEIKDINKKDRLSKLIIKHFPFLEATTYRQNPTDTTKQKEEKQAEAQSLESLKKSFFVFIYKLRDLRNHYSHYKHSKSLERPKFEEDLQNKMYNIFDVSIQFVKEDYKHNTDINPKKDFKHLDRKRKGKFHYSFADNEGNITESGLLFFVSLFLEKKDAIWVQKKLEGFKCSNKSYQKMTNEVFCRSRMLLPKLRLESTQTQDWILLDMLNELIRCPKSLYERLQGVNRKKFYVSFDPADEDYDAEQEPFKNTLVRHQDRFPYFALRYFDYNEVFANLRFQIDLGTYHFSIYKKLIGGQKEDRHLTHKLYGFERIQEFDKQNRPDEWKAIVKDSDTFKKKEEKEEEKPYISETTPHYHLENKKIGIAFKNHNIWPSTQTELTNNKRKKYNLGTSIKAEAFLSVHELLPMMFYYLLLKTENTKNDNKVGGKKETKKQGKHKIEAIIESKIKDIYALYDAFANGEINSEDELKEYLKGKDIKIVHLPKQMIAILKNEHKDMAEKAEAKQEKMKLATENRLKTLDKQLKGKIQNGKRYNSAPKSGEIASWLVNDMMRFQPVQKDENGESLNNSKANSTEYQLLQRTLAFFGSEHERLAPYFKQTKLIESSNPHPFLNDTEWEKCSNILSFYRSYLKARKNFLESLKPEDWEKNQYFLMLKEPKTNRETLVQGWKNGFNLPRDFFTEPIRKWFMEHWKSIKVDDLKRVGLVAKVTPLFFSEKYKDSVQPFYNYPFNVGDVNKPKEEDFLHREERIELWDKKKDKFKGYKAKKKFKEMTDKEKEEHRSYLEFQSWNKFERELRLVRNQDIVTWLLCTELIDKLKIDELNIKELKKLRLKDINTDTAKKEKNNILNRVMPMELPVTVYKVNKGGYIIKNKPLHTIYIKEAETKLLKQGNFKALVKDRRLNGLFSFVKTPSEAESESNPISKLRVEYELGKYQNARLDIIEDMLALEKKLIDKYNSLDTDNFHNMLTGWLELKGEAKKARFQNDVKLLTAVRNAFSHNQYPMYDENLFGNIERFSLSSSNIIESKGLDIAAKLKEEVSKAAKKIQNEEDNKKEKET

SEQ ID NO: 20 - protein, 1175 aa, unidentified
  source 1..1175: note = Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKIDHEHNDEVDPHYHFNHLVRKGKKDRYGHNDNPSFKHHFVDGEGMVTEAGLLFFVSLFLEKRDAIWMQKKIRGFKGGTETYQQMTNEVFCRSRISLPKLKLESLRMDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAEKVQGRIKRVIEDVYAVYDAFARDEINTRDELDACLADKGIRRGHLPRQMIAILSQEHKDMEEKIRKKLQEMMADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHETRWESHTNILSFYRSYLRARKAFLERIGRSDRVENRPFLLLKEPKTDRQTLVAGWKGEFHLPRGIFTEAVRDCLIEMGHDEVASYKEVGFMAKAVPLYFERACEDRVQPFYDSPFNVGNSLKPKKGRFLSKEERAEEWERGKERFRDLEAWSYSAARRIEDAFAGIEYASPGNKKKIEQLLRDLSLWEAFESKLKVRADRINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDDRLNGLFSFVDTGGLAMEQYPISKLRVEYELAKYQTARVCVFELTLRLEESLLTRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 21 - protein, 1118 aa, Porphyromonas gingivalis
MTEQNEKPYNGTYYTLEDKHFWAAFLNLARHNAYITLAHIDRQLAYSKADITNDEDILFFKGQWKNLDNDLERKARLRSLILKHFSFLEGAAYGKKLFESQSSGNKSSKKKELSKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREGTVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARDEINTRDELDACLADKGIRRGHLPRQMIAILSQEHKDMEEKVRKKLQEMIADTDHRLDMLDRQTDRKIRIGTKNAGLPKSGVVADWLVRDMMRFQPVAKDTSGKPLNNSKANSTEYRMLQRALALFGGEKERLTPYFRQMNLTGGNNPHPFLHETRWESHTNILSFYRSYLEARKAFLQSIGRSDRVENHRFLLLKEPKTDRQTLVAGWKGEFHLPRGIFTEAVRDCLIEMGYDEVGSYKEVGFMAKAVPLYFERASKDRVQPFYDYPFNVGNSLKPKKGRFLSKEKRAEEWESGKERFRAKLKKEILEAKEHPYHDFKSWQKFERELRLVKNQDIITWMMCRDLMEENKVEGLDTGTLYLKDIRTDVQEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDETLFSSIRKYDPSSPDAIEERMGLNIAHRLSEEVKQAKEMVERIIQA

SEQ ID NO: 22 - protein, 1131 aa, Prevotella intermedia
MEDDKKTKESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAKAQSFDSLKHCLFLFLEKLQEARNYYSHYKYSESTKEPMLEKELLKKMYNIFDDNIQLVIKDYQHNKDINPDEDFKHLDRTEEEFNYYFTTNKKGNITASGLLFFVSLFLEKKDAIWMQQKLRGFKDNRESKKKMTHEVFCRSRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRTDEWKAIVKDFDTYETSEEPYISETAPHYHLENQKIGIRFRNDNDEIWPSLKTNGENNEKRKYKLDKQYQAEAFLSVHELLPMMFYYLLLKKEEPNNDKKNASIVEGFIKREIRDIYKLYDAFANGEINNIDDLEKYCEDKGIPKRHLPKQMVAILYDEHKDMAEEAKRKQKEMVKDTKKLLATLEKQTQGEIEDGGRNIRLLKSGEIARWLVNDMMRFQPVQKDNEGNPLNNSKANSTEYQMLQRSLALYNKEEKPTRYFRQBNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSEEYEKVETLDRVGLVTKVIPLFFKKEDSKDKEEYLKKDAQKEINNCVQPFYGFPYNVGNIHKPDEKDFLPSEERKKLWGDKKYKFKGYKAKVKSKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSETELKSNPISKSLVEYELGEYQNARIETIKDMLLLEETLIEKYKTLPTDNFSDMLNGWLEGKDEADKARFQNDVKLLVAVRNAFSHNQYPMRNRIAFANINPFSLSSADYSEEKKLDIANQLKDKTHKIIKRIIEIEKPIETKE

SEQ ID NO: 23 - protein, 1127 aa, Prevotella buccae
MQKQDKLFVDRKKNAIFAFPKYITIMENKEKPEPIYYELTDKHFWAAFLNLARHNVYTTINHINRRLEIAELKDDGYMMGIKGSWNEQAKKLDKKVRLRDLIMKHFPFLEAAAYEMTNSKSPNNKEQREKEQSEALSLNNLKNVLFIFLEKLQVLRNYYSHYKYSEESPKPIFETSLLKNMYKVFDANVRLVKRDYMHHENIDNQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYNAEEEPFKNTLVRHQDRFPYFVLRYFDLNEIFEQLRFQIDLGTYHFSIYNKRIGDEDEVRHLTHHLYGFARIQDFAPQNQPEEWRKLVKDLDHFETSQEPYISKTAPHYHLENEKIGIKFCSAHNNLFPSLQTDKTCNGRSKFBLGTQFTAEAFLSVHELLPMMFYYLLLTKDYSRKESADKVEGIIRKEISNIYAIYDAFANNEINSIADLTRRLQNTNILQGHLPKQMISILKGRQKDMGKEAERKIGEMIDDTQRRLDLLCKQTNQKIRIGKRNAGLLKSGKIADWLVNDMMRFQPVQKDQNNIPINNSKANSTEYRMLQRALALFGSENFRLKAYFNQMNLVGNDNPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNRLKPKKRQFLDKKERVELWQKNKELFKNYPSEKKKTDLAYLDFLSWKKFERELRLIKNQDIVTWLMFKELFNMATVEGLKIGEIHLRDIDTNTANEESNNILNRIMPMKLPVKTYETDNKGNILKERPLATFYIEETETKVLKQGNFKALVKDRRLNGLFSFAETTDLNLEEHPISKLSVDLELIKYQTTRISIFEMTLGLEKKLIDKYSTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 24 - protein, 1179 aa, unidentified
  source 1..1179: note = Porphyromonas gulae
MTEQSERPYNGTYYTLEDKHFWAAFLNLARHNAYITLTHIDRQLAYSKADITNDQDVLSPKALWKNFDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKIDHEHNDEVDPHYHFNHLVRKGKKDRYGHNDNPSFKHHFVDGEGMVTEAGLLFFVSLFLEKRDAIWMQKKIRGFKGGTETYQQMTNEVFCRSRISLPKLKLESLRMDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAERVQGRIKRVIEDVYAVYDAFARARDEINTRDELDACLADKGIRRGHLPRQMIAILSQEHKDMEEKIRKKLQEMMADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHETRWESHTNILSFYRSYLRARKAFLERIGRSDRRVENRPFLLLKEPKTDRQTLVAGWKGEFHLPRGIFTEAVRDCLIEMGHDEVASYKEVGFMAKAVPLYFERACEDRVQPFYDSPFNVGNSLKPKKGRFLSKEERAEEWERGKERFRDLEAWSYSAARRIEDAFAGIEYASPGNKKKIEQLLRDLSLWEAFESKLKVRADRINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLLRLEESLLTRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 25 - protein, 1151 aa, Flavobacterium branchiophilum
MENLNKILDKENEICISKIFNTKGIAAPITEKALDNIKSKQKNDLNKEARLHYFSIGHSFKQIDTKKVFDYVLIEELKDEKPLKFITLQKDFFTKEFSIKLQKLINSIIRNINNHYVHNFNDINLNKIDSNVFHFLKESFELAIIEKYYKVNKKYPLDNEIVLFLKELFIKDENTALLNYFTNLSKDEAIEYILTFTITENKIWNINNEHNILNIEKGKYLTFEAMLFLITIFLYKNEANHLLPKLYDFKNNKSKQELFTFFSKKFTSQDIDAEEGHLIKFRDMIQYLNHYPTAWNNDLKLESENKNKIMTTKLIDSIIEFELNSNYPSFATDIQFKKEAKAFLFASNKKRNQTSFSNKSYNEEIRHNPHIKQYRDEIASALTPISFNVKEDKFKIFVKKHVLEEYFPNSIGYEKFLEYNDFTEKEKEDFGLKLYSNPKTNKLIERIDNHKLVKSHGRNQDRFMDFSMRFLAENNYFGKDAFFKCYKFYDTQEQDEFLQSNENNDDVKFHKGKVTTYIKYEEHLKNYSYWDCPFVEENNSMSVKISIGSEEKILKIQRNLMIYFLENALYNENVENQGYKLVNNYYRELKKDVEESIASLDLIKSNPDFKSKYKKILPKRLLHNYAPAKQDKAPENAFETLLKKADFREEQYKKLLKKAEHEKNKEDFVKRNKGKQFKLHFIRKACQMMYFKEKYNTLKEGNAAFEKKDPVIEKRKNKEHEFGHHKNLNITREEFNDYCKWMFAFNGNDSYKKYLRDLFSEKHFFDNQEYKNLFESSVNLEAFYAKTKELFKKWIETNKPTNNENRYTLENYKNLILQKQVFINVYHFSKYLIDKNLLNSENNVIQYKSLENVEYLISDFYFQSKLSIDQYKTCGKLFNKLKSNKLEDCLLYEIAYNYIDKKNVHKIDIQKILTSKIILTINDANTPYKISVPFNKLERYTEMIAIKNQNNLKARFLIDLPLYLSKNKIKKGKDSAGYEIIIKNDLEIEDINTINNKIINDSVKFTEVLMELEKYFILKDKCILSKNYIDNSEIPSLKQFSKVWIKENENEIINYRNIACHFHLPLLETFDNLLLNVEQKFIKEELQNVSTINDLSKPQEYLILLFIKFKHNNFYLNLFNKNESKTIKNDKEVKKNRVLQKFINQVILKKK

SEQ ID NO: 26 - protein, 954 aa, unidentified
  source 1..954: note = Alistipes sp.
MSNEIGAFREHQFAYAPGNEKQEEATFATYFNLALSNVEGMMFGEVESNPDKIEKSLDTLPPAILRQIASFIWLSKEDHPDKAYSTEEVKVIVTDLVRRLCFYRNYFSHCFYLDTQYFYSDELVDTTAIGEKLPYNFHHFITNRLFRYSLPEITLFRWNEGERKYEILRDGLIFFCCLFLKRGQAERFLNELRFFKRTDEEGRIKRTIFTKYCTRESHKHIGIEEQDFLIFQDIIGDLNRVPKVCDGVVDLSKENERYIKNRETSNESDENKARYRLLIREKDKFPYYLMRYIVDFGVLPCITFKQNDYSTKEGRGQFHYQDAAVAQEERCYNFVVRNGNVYYSYMPQAQNVVRISELQGTISVEELRNMVYASINGKDVNKSVEQYLYHLHLLYEKILTISGQTIKEGRVDVEDYRPLLDKLLLRPASNGEELRRELRKLLPKRVCDLLSNRFDCSEGVSAVEKRLKAILLRHEQLLLSQNPALHIDKIKSVIDYLYLFFSDDEKFRQQPTEKAHRGLKDEEFQMYHLVGDYDSHPLALWKELEASGRLKPEMRKLTSATSLHGLYMLCLKGTVEWCRKQLMSIGKGTAKVEAIADRVGLKLYDKLKLKEYTPEQLEREVKLVVMHGYAAAATPKPKAQAAIPSKLTELRFYSFLGKREMSFAAFIRQDKKAQKLWLRNFYTVENIKTLQKRQAAADAACKKLYNLVGEVERVHTNDKVLVLVAQRYRERLLNVGSKCAVTLDNPERQQKLADVYEVQNAWLSIRFDDLDFTLTHVNLSNLRKAYNLIPRKHILAFKEYLDNRVKQKLCEECRNVRRKEDLCTCCSPRYSNLTSWLKENHSESSIEREAATMMLLDVERKLLSFLLDERRKAIIEYGKFIPFSALVKECRLADAGLCGIRNDVLHDNVISYADAIGKLSAYFPKEASEAVEYIRRTKEVREQRREELMANSSQ

SEQ ID NO: 27 - protein, 1200 aa, Capnocytophaga canimorsus
MKNIQRLGKGNEFSPFKKEDKFYFGGFLNLANNNIEDFFKEIITRFGIVITDENKKPKETFGEKILNEIFKKDISIVDYEKWVNIPADYFPFTKYLSLYLEEMQFKNRVICFRDVMKELLKTVEALRNFYTHYDHEPIKIEDRVFYFLDKVLLDVSLTVKNKYLKTDKTKEFLNQHIKEELKELCKQRKDYLVGKGKRIDKESEIINGIYNNAFKDFICKREKQDDKENHNSVEKILCNKEPQNKKQKSSATVWELCSKSSSKYTEKSFPNRENDKHCLEVPISQKGIVFLLSFFLNKGEIYALTSNIKGFKAKITKEEPVTYDKNSIRYMATHRMFSFLAYKGLKRKIRTSEINYNEDGWASSTYEKETLMLQMLDELNKVPDVVYQNLSEDVQKTFIEDWNEYLKENNGDVGTMEEEQVIHPVIRKRYEDKFNYFAIRFLDEFAQFPTLRFQVHLGNYLLCDKRTKQICDTTTEREVKKKITVFGRLSELENKKAIFLNEREEIKGWEVFPNPSYDFPKENISVNYKDFPIVGSILDREKQPVSNKIGIRVKIADELQREIDKAIKEKKLRNPKNRKANQDEKQKERLVNEIVSTNSNEQGEPVVFIGQPTAYLSMNDIHSVLYEFLINKISGEALETKIVEKIETQIKQIIGKDATTKILKPYTNANSNSINREKLLRDLEQEQQILKTLLEEQQQREKDKKDKKSKRKHELYPSEKGKVAVWLANDIKRFMPKAFKEQWRGYHHSLLQKYLAYYEQSKEELKNLLPKEVFKHFPFKLKGYFQQQYLNQFYTDYLKRRLSYVNELLLNIQNFKNDKDALKATEKECFKFFRKQNYIINPINIQIQSILVYPIFLKRGFLDEKPTMIDREKFKENKDTELADWFMHYKNYKEDNYQKFYAYPLEKVEEKEKFKRNKQINKQKKNDVYTLMMVEYIIQKIFGDKFVEENPLVLKGIFQSKAERQQNNTHAATTQERNLNGILNQPKDIKIQGKITVKGVKLKDIGNFRKYEIDQRVNTFLDYEPRKEWMAYLPNDWKEKEKQGQLPPNNVIDRQISKYETVRSKILLKDVQELEKIISDEIKEEHRHDLKQGKYYNFKYYILNGLLRQLKNENVENYKVFKLNTNPEKVNITQLKQEATDLEQKAFVLTYIRNKFAHNQLPKKEFWDYCQEKYGKIEKEKTYAEYFAEVFKREKEALIK

SEQ ID NO: 28 - protein, 1224 aa, Bergeyella zoohelcum
MENKTSLGNNIYYNPFKPQDKSYFAGYFNAAMENTDSVFRELGKRLKGKEYTSENFFDAIFKENISLVEYERYVKLLSDYFPMARLLDKKEVVPIKERKENFKKNFKGIIKAVRDLRNFYTHKEHGEVEITDEIFGVLDEMLKSTVLTVKKKKVKTDKTKEILKKSIEKQLDILCQKKLEYLRDTARKIEEKRRNQRERGEKELVAPFKYSDKRDDLIAAIYNDAFDVYIDKKKDSLKESSKAKYNTKSDPQQEEGDLKIPISKNGVVFLLSLFLTKQEIHAFKSKIAGFKATVIDEATVSEATVSHGKNSICFMATHEIFSHLAYKKLKRKVRTAEINYGEAENAEQLSVYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKENLISDRRIKEKITVFGRLSELEHKKALFIKNTETNEDREHYWEIFPNPNYDFPKENISVNDKDFPIAGSILDREKQPVAGKIGIKVKLLNQQYVSEVDKAVKAHQLKQRKASKPSIQNIIEEIVPINESNPKEAIVFGGQPTAYLSMNDIHSILYEFFDKWEKKKEKLEKKGEKELRKEIGKELEKKIVGKIQAQIQQIIDKDTNAKILKPYQDGNSTAIDKEKLIKDLKQEQNILQKLKDEQTVREKEYNDFIAYQDKNREINKVRDRNHKQYLKDNLKRKYPEAPARKEVLYYREKGKVAVWLANDIKRFMPTDFKNEWKGEQHSLLQKSLAYYEQCKEELKNLLPEKVFQHLPFKLGGYFQQKYLYQFYTCYLDKRLEYISGLVQQAENFKSENKVFKVENECFKFLKKQNYTHKELDARVQSILGYPIFLERGFMDEKPTIIKGKTFKGNEALFADWFRYYKEYQNFQTFYDTENYPLVELEKKQADRKRKTKIYQQKKNDVFTLLMAKHIFKSVFKQDSIDQFSLEDLYQSREERLGNQERARQTGERNTNYIWNKTVDLKLCDGKITVENVKLKNVGDFIKYEYDQRVQAFLKYEENIEWQAFLIKESKEEENYPYVVEREIEQYEKVRREELLKEVHLIEEYILEKVKDKEILKKGDNQNFKYYILNGLLKQLKNEDVESYKVFNLNTEPEDVNINQLKQEATDLEQKAFVLTYIRNKFAHNQLPKKEFWDYCQEKYGKIEKEKTYAEYFAEVFKKEKEALIK

SEQ ID NO: 29 - protein, 1090 aa, unidentified
  source 1..1090: note = Prevotella sp.
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGVVEIKALPEIAMSIKKAFGEYAIMK

SEQ ID NO: 30 - protein, 1097 aa, Riemerella anatipestifer
MEKPLLPNVYTLKHKFFWGAFLNIARHNAFITICHINEQLGLKTPSNDDKIVDVVCETWNNILNNDHDLLKKSQLTELILKHFPFLTAMCYHPPKKEGKKKGHQKEQQKEKESEAQSQAEALNPSKLIEALEILVNQLHSLRNYYSHYKHKKPDAEKDIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKKRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSEDLMLSKPIRKEIKKHGRVGFISRAITLYFKEKYQDKHQSFYNLSYKLEAKAPLLKREEHYEYWQQNKPQSPTESQRLELHTSDRWKDYLLYKRWQHLEKKLRLYRNQDDVMLWLMTLELTKNHFKELNLNYHQLKLENLAVNVQEADAKLNPLNQTLPMVLPVKVYPATAFGEVQYHKTPIRTVYIREEEHTKALKMGNFKALVKDRRLNGLFSFIKEENDTQKHPISQLRLRRELEIYQSLRVDAFKETLSLEEKLLNKHTSLSSLENEFRALLEEWKKEYAASSMVTDEHIAFIASVRNAFCHNQYPFYKEALHAPIPLFTVAQPTTEEKDGLGIAEALLKVLREYCEIVKSQI

SEQ ID NO: 31 - protein, 1306 aa, unidentified
  source 1..1306: note = Prevotella sp.
MSKECKKQRQEKKRRLQKANFSISLTGKHVFGAYFNMARTNFVKTINYILPIAGVRGNYSENQINKMLHALFLIQAGRNEELTTEQKQWEKKLRLNPEQQTKFQKLLFKHFPVLGPMMADVADHKAYLNKKKSTVQTESEAQSQAEALNPSKLIEALEILVNQLHSLRNYYSHYKHKKPDAEKDIFKHLYKAFDASLRMVKEDYKAHFTVNLTRDFAHLNRKGKVKDGKVMKTFVEYDDFYFKISGKRLVNGYTVTTKDDKPVNVNTMLPALSDFGLLYFCVLFLSKPYAKLFIDEVRLFEYSPFDDKENMIMSEMLSIYRIRTPRLHKIDSHDSKATLAMDIFGELRRCPMELYNLLDKNAGQPFFHDEVKHPNSHTPDVSKRLRYDDRFPTLALRYIDETELFKRIRFQLQLGSFRYKFYDKENCIDGRVRVRRIQKEINGYGRMQEVADKRMDKWGDLIQKREERSVKLEHEELYINLDQFLEDTADSTPYVTDRRPAYNIHANRIGLYWEDSQNPKQYKVFDENGMYIPELVVTEDKKAPIKMPAPRCALSVYDLPAMLFYEYLREQQDNEFPSAEQVIIEYEDDYRKFFKAVAEGKLKPFKRPKEFRDFLKKEYPKLRMADIPKKLQLFLFLCSHGLCYNNKPETVYERLDRLTLQHLEERELHIQNRLEHYQKDRDMIGNKDNQYGKKSFSDVRHGALARYLAQSMMEWQPTKLKDKEKGHDKLTGLNYNVLTAYLATYGHPQVPEEGFTPRTLEQQVLINAHLIGGSNPHPFINKVLALGNRNIEELYLHYLEEELKHIRSRIQSLSSNPSDKALSALPFIHHDRMRYHERTSEEMMALAARYTTIQLPDGLFTPYILEILQKHYTENSDLQNALSQDVPVKLNPTCNAAYLITLFYQTVLKDNAQPFYLSDKTYTRNKDGEKAESFSFKRAYELFSVLNNNKKDTFPFEMIPLFLTSDEIQERLSAKLLDGDGNPVPEVGEKGKPATDSQGNTIWKRRIYSEVDDYAEKLTDRDMKISFKGEWEKLPRWKQDKIIKRRDETRRQMRDEKKQRMPRYIRDIKDNERTLRRYKTQDMVLFLLAEKMFTNIISEQSSEFNWKQMRLSKVCNEAFLRQTLTFRVPVTVGETTIYVEQENMSLKNYGEFYRFLTDDRLMSLLNNIVETLKPNENGDLVIRHTDLMSELAAYDQYRSTIFMLIQSIENLIITNNAVLDDPDADGFWVREDLPKRNNFASLLELINQLNNVTDEHIAFIASVRNAFCHNQYNIDFSLIKDVKHLPEVAKGILQHLQSMLGVEITK

SEQ ID NO: 32 - protein, 1152 aa, unidentified
  source 1..1152: note = Prevotella saccharolytica
MEDKPFWAAFFNLARHNVYLTVNHINKLLDLEKLYDEGKHKEIFEREDIFNISDDVMNDANSNGKKRKLDIKKIWDDLDTDLTRKYQLRELILKHFPFIQPAIIGAQTKERTTIDKDKRSTSTSNDSLKQTGEGDINDLLSLSNVKSMFFRLLQILEQLRNYYSHVKHSKSATMPNFDEDLLNWMRYIFIDSVNKVKEDYSSNSVIDPNTSFSHLIYKDEQGKIKPCRYPFTSKDGSINAFGLLFFVSLFLEKQDSIWMQKKIPGFKKASENYMKMTNEVFCRNHILLPKIRLETVYDKDWMLLDMLNEVVRCPLSLYKRLTPAAQNKFKVPEKSSDNANRQEDDNPFSRILVRHHQNRFPYFVLRFFDLNEVFTTLRFQINLGCYHFAICKKQIGDKKEVHHLIRTLYGFSRLQNFTQNTRPEEWNTLVKTTEPSSGNDGKTVQGVPLPYISYTIPHYQIENEKIGIKIFDGDTAVDTDIWPSVSTEQLNKPDKYTLTPGFKADVFLSVHELLPMMFYYQLLLCEGMLKTDAGNAVEKVLIDTRNAIFNLYDAFVQEKINTITDLENYLQDKPILIGHLPKQMIDLLKGHQRDMLKAVEQKKAMLIKDTERRLKLLDKQLKQETDVAAKNTGTLLKNGQIADWLVNDMMRFQPVKRDKEGNPINCSKANSTEYQMLQRAFAFYATDSCRLSRYFTQLHLIHSDNSHLFLSRFEYDKQPNLIAFYAAYLKAKLEFLNELQPQNWASDNYFLLLRAPKNDRQKLAEGWKNGFNLPRGLFTEKIKTWFNEHKTIVDISDCDIFKNRVGQVARLIPVFFDKKFKDHSQPFYRYDFNVGNVSKPTEANYLSKGKREELFKSSYQNKFKNNIPAEKTKEYREYKNFSLWKKFERELRLIKNQDILIWLMCKNLFDEKIKPKKDILEPRIAVSYIKLDSLQTNTSTAGSLNALAKVVPMTLAIHIDSPKPKGKAGNNEKENKEFTVYIKEEGTKLLKWGNFKTLLADRRIKGLFSYIEHDDIDLKQHPLTKRRVDLELDLYQTCRIDIFQQTLGLEAQLLDKYSDLNTDNFYQMLIGWRKKEGIPRNIKEDTDFLKDVRNAFSHNQYPDSKKIAFRRIRKFNPKELILEEEEGLGIATQMYKEVEKVVNRIKRIELFD

SEQ ID NO: 33 - protein, 1118 aa, Porphyromonas gingivalis
MTEQNEKPYNGTYYTLEDKHFWAAFLNLARHNAYITLAHIDRQLAYSKADITNDEDILFFKGQWKNLDNDLERKARLRSLILKHFSFLEGAAYGKKLFESQSSGNKSSKKKELSKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREGTVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEVSAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVVADWLVRDMMRFQPVAKDTSGKPLNNSKANSTEYQMLQRALALFGGEKERLTPYFRQMNLTGGNNPHPFLHETRWESHTNILSFYRSYLEARKAFLQSIGRSDRVENHRFLLLKEPKTDRQTLVAGWKGEFHLPRGIFTEAVRDCLIEMGYDEVGSYKEVGFMAKAVPLYFERASKDRVQPFYDYPFNVGNSLKPKKGRFLSKEKRAEEWESGKERFRLAKLKKEILEAKEHPYHDFKSWQKFERELRLVKNQDIITWMMCRDLMEENKVEGLDTGTLYLKDIRTDVQEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDETLFSSIRKYDPSSPDAIEERMGLNIAHRLSEEVKQAKEMVERIIQA

SEQ ID NO: 34 - protein, 1132 aa, Prevotella intermedia
MEDDKKTKESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAKAQSFDSLKHCLFLFLEKLQEARNWWSHYKYSESTKEPMLEKELLKKMYNIFDDNIQLVIKDYQHNKDINPDEDFKHLDRTEEEFNYYFTTNKKGNITASGLLFFVSLFLEKKDAIWMQQKLRGFKDNRESKKKMTHEVFCRSRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRTDEWKAIVKDFDTYETSEEPYISETAPHYHLENQKIGIRFRNDNDEIWPSLKTNGENNEKRKYKLDKQYQAEAFLSVHELLPMMFYYLLLKKEEPNNDKKNASIVEGFIKREIRDIYKLYDAFANGEINNIDDLEKYCEDKGIPKRHLPKQMVAILYDEHKDMAEEAKRKQKEMVKDTKKLLATLEKQTQGEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSEEYEKVETLDRVGLVTKVIPLFFKKEDSKDKEEYLKKDAQKEINNCVQPFYGFPYNVGNIHKPDEKDFLPSEERKKLWGDKKYKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMELPVTVYEIDDSHNIVKDRPLHTVYIEETKTKLLKQGNFKALVKDRRLNGLFSFVDTSSETELKSNPISKSLVEYELGEYQNARIETIKDMLLLEETLIEKYKTLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 35 - protein, 1126 aa, unidentified
  source 1..1126: note = Prevotella aurantiaca
MEDDKKTTGSISYELKDKHFWAAFLNLARHNVYITINHINKLLEIREIDNDEKVLDIKTLWQKGNKDLNQKARLRELMTKHFPFLETAIYTKNKEDKKEVKQEKQAEAQSLESLKDCLFLFLDKLQEARNYYSHYKYSEFSKEPEFEEGLLEKMYNIFGNNIQLVINDYQHNKDINPDEDFKHLDRKGQFKYSFADNEGNITESGLLFFVSLFLEKKDAIWMQQKLNGFKDNLENKKKMTHEVFCRSRIILMPKLRLESTQTQDWILLDMLNELIRCPKSLYERLQGDDREKFKVPFDPPADEDYNAEQEPFKNTLIRHQDRFPYFVLRYFDYNEIFKNLRFQIDLGTYHFSIYKKLIGGQKEDRHLTHKLYGFERIQEFAKQNRPDEWKAIVKDLDTYETSNKRYISETTPHYHLENQKIGIRFRNGNKEIWPSLKTNDENNEKSKYKLDKQYQAEAFLSVHELLPMMFYYLLLKKEKPNNDEINASIVEGFIKREIRNIFKLYDAFANGEINNIDDLEKYCADKGIPKRHLPKQMVAILYDEHKDMVKEAKRKQKEMVKDTKKLLATLEKQTQKEKEDDGRNVKLLKSGEIARWLVNDMMRFQPVQKDNEGKPLNNSKANSTEYQMLQRSLALYNNEEKPTRYFRQVNLIESNNPHPFLKWTKWEECNNILTFYYSYLTKKIEFLNKLKPEDWKKNQYFLKLKEPKTNRETLVQGWKNGFNLPRGIFTEPIREWFKRHQNNSKEYEKVEALDRVGLVTKVIPLFFKEEYFKDKEENFKEDTQKEINDCVQPFYNFPYNVGNIHKPKEKPFLHREERIELWDKKKDKFKGYKEKIKSKKLTEKDKEEFRSYLEFQSWNKFERELRLVRNQDIVTWLLCKELIDKLKIDELNIEELKKLRLNNIDTDTAKKEKNNILNRVMPMELPVTVYEIDDSHKIVKDKPLHTIYIKEAETKLLKQGNFKALVDKRRLNGLFSFVKTNSEAESKRNPISKLRVEYELGEYQEARIEIIQDMLALEEKLINKYKDLPTNKFSEMLNSWLEGKDEADKARFQNDVDFLIAVRNAFSHNQYPMHNKIEFANIKPFSLYTANNSEEKGLGIANQLKDKTKETTDKIKKIEKPIETKE

SEQ ID NO: 36 - protein, 1120 aa, Prevotella intermedia
MEDDKKTTDSIRYELKDKHFWAAFLNLARHNVYITVNHINKILEEDEINRDGYENTLENSWNEIKDINKKDRLSKLIIKHFPFLEATTYRQNPTDTTKQKEEKQAEAQSLESLKKSFFVFIYKLRDLRNHYSHYKHSKSLERPKFEEDLQNKMYNIFDVSIQFVKEDYKHNTDINPPKKDFKHLDRKRKGKFHYSFADNEGNITESGLLFFVSLFLEKKDAIWVQKKLEGFKCSNKSYQKMTNEVFCRSRMLLPKLRLESTQTQDWILLDMLNELIRCPKSLYERLQGVNRKKFYVSFDPADEDYDAEQEPFKNTLVRHWDRFPYFALRYFDYNEVFANLRFQIDLGTYHFSIYKKLIGGQKEDRHLTLKLYGFERIQEFDKQNRPDEWKAIVKDSDTFKKKEEKEEEKPYISETTPHYHLENKKIGIAFGNHNIWPSTQTELTNNKRKKYNLGYSIKAEAFLSVHELLPMMFYYLLLKTENTKNDNKVGGKKETGKQGKHKIEAIIESKIKDIYALYDAFANGEINSEDELKEYLKGKDIKIVHLPKQMIAILKNEHKDMAEKAEAKQEKMKLATENRLKTLDKQLKGKIQNGKRYNSAPKSGEIASWLVNDMMFRQPVQKDENGESLNNSKANSTEYQLLQRTLAFFGSEHERLAPYFKQTKLIESSNPHPFLNDTEWEKCSNILSFYRSLKARKNFLESLKPEDWEKNQYFLMLKEPKTNRETLVQGWKNGFNLPRGFFTEPIRKWFMEHWKSIKVDDLKRVGLVAKVTPLFFSEKYKDSVQPFYNYPFNVGDVNKPKEEDFLHREERIELWDKKKDKFKGYKAKKKFKEMTDKEKEEHRSYLEFQSWNKFERELRLVRNQDIVTWLLCTELIDKLKIDELNIKELKKLRLKDINTDTALKEKNNILNRVMPMELPVTVYKVNKGGYIIKNKPLHTIYIKEAETKLLKQGNFKALVKDRRLNGLFSFVKTPSEAESESNPISKLRVEYELGKYQNARLDIIEDMLALEKKLIDKYNSLDTDNFHNMLTGWLELKGEAKKARFQNDVKLLTAVRNAFSHNQYPMYDENLFGNIERFSLSSSNIIESKGLDIAAKLKEEVSKAAKKIQNEEDNKREKET

SEQ ID NO: 37 - protein, 1126 aa, Prevotella intermedia
MEDDKKTTDSIRYELKDKHFWAAFLNLARHNVYITVNHINKILEEGEINRDGYETTLKNTWNEIKDINKKDRLSKLIIKHFPFLEAATYRLNPTDTTKQKEEKQAEAQSLESLRKSFFVFIYKLRDLRNHYSHYKHSKSLERPKFEEGLLEKMYNIFNASIRLVKEDYQYNKDINPDEDFKHLDRTEEEFNYYFTKDNEGNITESGLLFFVSLFLEKKDAIWMQQKLRGFKDNRENKKKMTNEVFCRSRMLLPKLRLQSTQTQDWILLDMLNELIRCPKSLYERLREEDREKFRVPIEIADEDYDAEQEPFKNTLVRHQDRFPYFALRYFDYNEIFTNLRFQIDLGTYHFSIYKKQIGDYKESHHLTHKLYGFERIQEFTKQNRPDEWRKFVKTFNSFETSKEPYIPETTPHYHLENQKIGIRFRNDNDKIWPSLKTNSEKNEKSKYKLDKSFQAEAFLSVHELLPMMFYYLLLKTENTDNDNEIETKKKENKNDKQEKHKIEEIIENKITEIYALYDTFANGEIKSIDELEEYCKGKDIEIGHLPKQMIAILKDEHKVMATEAERKQEEMLVDVQKSLESLDNQINEEIENVERKNSSLKSGKIASWLVNDMMRFQPVQKDNEGKPLNNSKANSTEYQLLQRTLAFFGSEHERLAPYFKQTKLIESSNPHPFLKDTEWEKCNNILSFYRSYLEAKKNFLESLKPEDWEKNQYFLKLKEPKTKPKTLVQGWKNGFNLPRGIFTEPIRKWFMKHRENITVAELKRVGLVAKVIPLFFSEEYKDSVQPFYNYHFNVGNINKPDEKNFLNCEERRELLRKKKDEFKKMTDKEKEENPSYLEFKSWNKFERELRLVRNQDIVTWLLCMELFNKKKIKELNVEKIYLKNINTNTTKKEKNTEEKNGEEKNIKEKNNILNRIMPMRLPIKVYGRENFSKNKKKKIRRNTFFTVYIEEKGTKLLKQGNFKALERDRRLGGLFSFVKTPSKAESKSNTISKLRVEYELGEYQKARIEIIKDMLALEKTLIDKYNSLDTDNFNKMLTDWLELKGEPDRASFQNDVDLLIAVRBAFSHNQYPMRNRIAFANINPFSLSSANTSEEKGLGIANQLKDKTHKTIEKIIEIEKPIETKE

SEQ ID NO: 38 - DNA, 80 bp, synthetic construct
  source 1..80: mol_type = other DNA; note = Synthetic Oligonucleotide
cggaagctttggaagtactgaaggatcgtcctttgtacgccgaaaaatgagcaccatttactaaagaattagcagtcatg

SEQ ID NO: 39 - DNA, 80 bp, synthetic construct
  source 1..80: mol_type = other DNA; note = Synthetic Oligonucleotide
aatacagtcaaattgcagtactctgcgggtgtatacagaatagcagaataggcagacattacgaatgcacacggtgtggt

SEQ ID NO: 40 - DNA, 33 bp, synthetic construct
  source 1..33: mol_type = other DNA; note = Synthetic Oligonucleotide
gctgaagaagcctccgatttgtggggtgattac

SEQ ID NO: 41 - DNA, 33 bp, synthetic construct; identical to SEQ ID NO: 40
  source 1..33: mol_type = other DNA; note = Synthetic Oligonucleotide

SEQ ID NO: 42 - DNA, 47 bp, synthetic construct
  source 1..47: mol_type = other DNA; note = Synthetic Oligonucleotide
gtaatcactccacaaatcggaggcttcttcagcgtggaaattctgga

SEQ ID NO: 43 - DNA, 36 bp, synthetic construct
  source 1..36: mol_type = other DNA; note = Synthetic Oligonucleotide
gtgctggagaagcccccgatttgtggggtgattaca

SEQ ID NO: 44 - DNA, 36 bp, synthetic construct; identical to SEQ ID NO: 43
  source 1..36: mol_type = other DNA; note = Synthetic Oligonucleotide

SEQ ID NO: 45 - DNA, 47 bp, synthetic construct
  source 1..47: mol_type = other DNA; note = Synthetic Oligonucleotide
tgtaatcaccccacaaatcgggggcttctccagcgccgtaaaagttg

SEQ ID NO: 46 - protein, 248 aa, synthetic construct
  source 1..248: note = Synthetic Peptide
KAAFNARNTHILWDLLKHFPFLEKSLFLLLRNYYSHYKFDIFHLRKITGLLFFVSLFLEKAKGFKTEVFPKLDMLELRCPLYLFFLRDRFPYFALRYDFLRFQLGYHYKIRHLGFRQEITPHYEKIGSKYAELSVELMFYLEILILPKLDKTLLLKGALDMFQPDPNNERAELFLINPHPFNFYYLLLLLVKLPGFTVQPFYFKFEEWWKEELDMLLNLTYIKLLGNFDRLLELYRLLELLVANQYIL

SEQ ID NO: 47 - protein, 801 aa, synthetic construct
  source 1..801: note = Synthetic Peptide
MQVENIKKGSSQGMYSIEQYEGKKWCFAIVLNRAQTNLQGNPKLFEETLTRFERIRKEDWFDQETKKLIYAKQEQNEVEEEIQKAADEKLRDLRNYFSHYFHTPDCLIFTQNDPVRIIMEKAYEKARFEQAKKEQEDISIEFGELFEENGRITSAGVVFFASFFAERRFLNRLMGYVQGFTRTEGEYKITRDVFSTYCLRDSYSVKTPDHDAVMFRDILGYLSRVPSESYQRIKESQMRSETQLSERKTDKFILFALNYLEDYGLEDLADYTACFARTRIKREQDENTDGKEQKPHRKKPRVEIHFERAEGDPFYIKHNNVILRTQKKGAQTYIFRMGVYELKYLVLLSLLGKGAEAVKRIDRYVHSLRNQLPHIEKKSTEEIEGYVRFLPRFVRSHLGLLGVDDEKKIKARVDYVKAKWLEKKEKSRELQLHRKGRDILRYINERCERPLNIDEYNRILELLVTKHLDGFYRELEELKKTRRIDKNIVCNLSRHKSVNALHEKVCDLVVQELESLGREELKEYVGLIPKEEKEVSFEEKTDRVVKQPVIYKGFLRNEFFRESRKSFARLVEEAVREKGEVYDVPLGGEYYEIVSLDTFDKDNKRLYETLAMDRLLLMIARQYHLSLNKELAKRAQQIEWKKEDGEEVIIFTLKNPAQPEQSCSVRFSLRDYTKLYVMDDAEFLARLCDYFLPKDEEQIDYHRLYTQGMNRYTNLQREGIEAILELEKKTIGPEQPRPPKNYIPFSEIMDKSAYNEDDQKALRRVRNALLHHNLNFARADFKRFCGIMKREGIEKRWSLAV

SEQ ID NO: 48 - protein, 775 aa, synthetic construct
  source 1..775: note = Synthetic Peptide
MAQVSKQTSKKRELSIDEYQGARKWCFTIAFNKALVNRDKNDGLFVESLLRHEKYSKHDWYDEDTRALIKCSTQAANAKAEALRNYFSHYRHSPGCLTFTAEDELRTIMERAYERAIFECRRRETEVIIEFPSLFEGDRITTAGVVFFVSFFVERRVLDRLYGAVSGLKKNEGQYKLTRKALSMYCLKDSRFTKAWDKRVLLFRDILAQLGRIPAEAYEYYHGEQGDKKRANDNEGTNPKRHKDKFIEFALHYLEAQHSEICFGRRHIVREEAGAGDEHKKHRTKGKVVVDFSKKDEDQSYYISKNNVIVRIDKNAGPRSYRMGLNELKYLVLLSLQGKGDDAIAKLYRYRQHVENILDVVKVTDKDNHVFLPRFVLEQHGIGRKAFKQRIDGRVKHVRGVWEKKKAATNEMTLHEKARDILQYVNENCTRSFNPGEYNRLLVCLVGKDVENFQAGLKRLQLAERIDGRVYSIFAQTSTINEMHQVVCDQILNRLCRIGDQKLYDYVGLGKKDEIDYKQKVAWFKEHISIRRGFLRKKFWYDSKKGFAKLVEEHLESGGGQRDVGLDKKYYHIDAIGRFEGANPALYETLARDRLCLMMAQYFLGSVRKELGNKIVWSNDSIELPVEGSVGNEKSIVFSVSDYGKLYVLDDAEFLGRICEYFMPHEKGKIRYHTVYEKGFRAYNDLQKKCVEAVLAFEEKVVKAKKMSEKEGAHYIDFREILAQTMCKEAEKTAVNKVRRAFFHHHLKFVIDEFGLFSDVMKKYGIEKEWKFPVK

SEQ ID NO: 49 - protein, 1175 aa, synthetic construct
  source 1..1175: note = Synthetic Peptide
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKIDHEHNDEVDPHYHFNHLVRKGKKDRYGHNDNPSFKHHFVDGEGMVTEAGLLFFVSLFLEKRDAIWMQKKIRGFKGGTETYQQMTNEVFCRSRISLPKLKLESLRMDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAERVQGRIKRVIEDVYAVYDAFARDEINTRDELDACLADKGIRRGHLPRQMIAILSQEHKDMEEKIRKKLQEMMADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHETRWESHTNILSFYRSYLRARKAFLERIGRSDRVENRPFLLLKEPKTDRQTLVAGWKGEFHLPRGIFTEAVRDCLIEMGHDEVASYKEVGFMAKAVPLYFERACEDRVQPFYDSPFNVGNSLKPKKGRFLSKEERAEEWERGKERFRDLEAWSYSAARRIEDAFAGIEYASPGNKKKIEQLLRDLSLWEAFESKLKVRADRINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 50 - protein, 1119 aa, synthetic construct
  source 1..1119: note = Synthetic Peptide
MTEQNEKPYNGTYYTLEDKHFWAAFLNLARHNAYITLAHIDRQLAYSKADITNDEDILFFKGQWKNLDNDLERKARLRSLILKHFSFLEGAAYGKKLFESQSSGNKSSKKKELSKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREGTVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVVADWLVRDMMRFQPVAKDTSGKPLNNSKANSTEYRMLQRALALFGGEKERLTPYFRQMNLTGGNNPHPFLHETRWESHTNILSFYRSYLEARKAFLQSIGRSDRVENHRFLLLKEPKTDRQTLVAGWKGEFHLPRGIFTEAVRDCLIEMGYDEVGSYKEVGFMAKAVPLYFERASKDRVQPFYDYPFNVGNSLKPKKGRFLSKEKRAEEWESGKERFRLAKLKKEILEAKEHPYHDFKSWQKFERELRLVKNQDIITWMMCRDLMEENKVEGLDTGTLYLKDIRTDVQEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDETLFSSIRKYDPSSPDAIEERMGLNIAHRLSEEVKQAKEMVERIIQA

SEQ ID NO: 51 - protein, 1127 aa, synthetic construct
  source 1..1127: note = Synthetic Peptide
MQKQDKLFVDRKKNAIFAFPKYITIMENKEKPEPIYYELTDKHFWAAFLNLARHNVYTTINHINRRLEIAELKDDGYMMGIKGSWNEQAKKLDKKVRLRDLIMKHFPFLEAAAYEMTNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYNAEEEPFKNTLVRHQDRFPYFVLRYFDLNEIFEQLRFQIDLGTYHFSIYNKRIGDEDEVRHLTHHLYGFARIQDFAPQNQPEEWRKLVKDLDHFETSQEPYISKTAPHYHLENEKIGIKFCSAHNNLFPSLQTDKTCNGRSKFNLGTQFTAEAFLSVHELLPMMFYYLLLTKDYSRKESADKVEGIIRKEISNIYAIYDAFANNEINSIADLTRRLQNTNILQGHLPKQMISILKGRQKDMGKEAERKIGEMIDDTQRRLDLLCKQTNQKIRIGKRNAGLLKSGKIADWLVNDMMRFQPVQKDQNNIPINNSKANSTEYRMLQRALALFGSENFRLKAYFNQMNLVGNDNPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNRLKPKKRQFLDKKERVELWQKNKELFKNYPSEKKKTDLAYLDFLSWKKFERELRLIKNQDIVTWLMFKELFNMATVEGLKIGEIHLRDIDTNTANEESNNILNRIMPMKLPVKTYETDNKGNILKERPLATFYIEETETKVLKQGNFKALVKDRRLNGLFSFAETTDLNLEEHPISKLSVDLELIKYQTTRISIFEMTLGLEKKLIDKYSTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 52 - protein, 1125 aa, synthetic construct
  source 1..1125: note = Synthetic Peptide
MEDDKKTTGSISYELKDKHFWAAFLNLARHNVYITINHINKLLEIREIDNDEKVLDIKTLWQKGNKDLNQKARLRELMTKHFPFLETAIYTKNKEDKKEVKQEKQAEAQSLESLKDCLFLFLDKLQEARNYYSHYKYSEFSKEPEFEEGLLEKMYNIFGNNIQLVINDYQHNKDINPDEDFKHLDRKGQFKYSFADNEGNITESGLLFFVSLFLEKKDAIWMQQKLNGFKDNLENKKKMTHEVFCRSRILMPKLRLESTQTQDWILLDMLNELIRCPKSLYERLQGDDREKFKVPFDPADEDYNAEQEPFKNTLIRHQDRFPYFVLRYFDYNEIFKNLRFQIDLGTYHFSIYKKLIGGQKEDRHLTHKLYGFERIQEFAKQNRPDEWKAIVKDLDTYETSNKRYISETTPHYHLENQKIGIKRFRNGNKEIWPSLKTNDENNEKSKYKLDKQYQAEAFLSVHELLPMMFYYLLLKKEKPNNDEINASIVEGFIKREIRNIFKLYDAFANGEINNIDDLEKYCADKGIPKRHLPKQMVAILYDEHKDMVKEAKRKQKEMVKDTKKLLATLEKQTQKEKEDDGRNVKLLKSGEIARWLVNDMMRFQPVQKDNEGKPLNNSKANSTEYQMLQRSLALYNNEEKPTRYFRQVNLIESNNPHPFLKWTKWEECNNILTFYYSYLTKKIEFLNKLKPEDWKKNQYFLKLKEPKTNRETLVQGWKNGFNLPRGIFTEPIREWFKRHQNNSKEYEKVEALDRVGLVTKVIPLFFKEEYFKDKEENFKEDTQKEINDCVQPFYNFPYNVGNIHKPKEKDFLHREERIELWDKKKDKFKGYKEKIKSKKLTEKDKEEFRSYLEFQSWNKFERELRLVRNQDIVTWLLCKELIDKLKIDELNIEELKKLRLNNIDTDTAKKEKNNILNRVMPMELPVTVYEIDDSHKIVKDKPLHTIYIKEAETKLLKQGNFKALVKDRRLNGLFSFVKTNSEAESKRNPISKLRVEYELGEYQEARIEIIQDMLALEEKLINKYKDLPTNKFSEMLNSWLEGKDEADKARFQNDVDFLIAVRNAFSHNQYPMHNKIEFANIKPFSLYTANNSEEKGLGIANQLKDKTKETTDKIKKIEKPIETKE

SEQ ID NO: 53 - protein, 1132 aa, synthetic construct
  source 1..1132: note = Synthetic Peptide
MEDDKKTKESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAKAQSFDSLKHCLFLFLEKLQEARNYYSHYKYSESTKEPMLEKELLKKMYNIFDDNIQLVIKDYQHNKDINPDEDFKHLDRTEEEFNYYFTTNKKGNITASGLLFFVSLFLEKKDAIWMQQKLRGFKDNRESKKKMTHEVFCRSRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRTDEWKAIVKDFDTYETSEEPYISETAPHYHLENQKIGIRFRNDNDEIWPSLKTNGENNEKRKYKLDKQYQAEAFLSVHELLPMMFYYLLLKKEEPNNDKKNASIVEGFIKREIRDIYKLYDAFANGEINNIDDLEKYCEDKGIPKRHLPKQMVAILYDEHKDMAEEAKRKQKEMVKDTKKLLATLEKQTQGEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSEEYEKVETLDRVGLVTKVIPLFFKKEDSKDKEEYLKKDAQKEINNCVQPFYGFPYNVGNIHKPDEKDFLPSEERKKLWGDKKYKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSETELKSNPISKSLVEYELGEYQNARIETIKDMLLLEETLIEKYKTLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 54 - protein, 1126 aa, synthetic construct
  source 1..1126: note = Synthetic Peptide
MEDDKKTTDSIRYELKDKHFWAAFLNLARHNVYITVNHINKILEEGEINRDGYETTLKNTWNEIKDINKKDRLSKLIIKHFPFLEAATYRLNPTDTTKQKEEKQAEAQSLESLRKSFFVFIYKLRDLRNHYSHYKHSKSLERPKFEEGLLEKMYNIFNASIRLVKEDYQYNKDINPDEDFKHLDRTEEEFNYYFTKDNEGNITESGLLFFVSLFLEKKDAIWMQQKLRGFKDNRENKKKMTNEVFCRSRMLLPKLRLQSTQTQDWILLDMLNELIRCPKSLYERLREEDREKFRVPIEIADEDYDAEQEPFKNTLVRHQDRFPYFALRYFDYNEIFTNLRFQIDLGTYHFSIYKKQIGDYKESHHLTHKLYGFERIQEFTKQNRPDEWRKFVKTFNSFETSKEPYIPETTPHYHLENQKIGIRFRNDNDKIWPSLKTNSEKNEKSKYKLDKSFQAEAFLSVHELLPMMFYYLLLKTENTDNDNEIETKKKENKNDKQEKHKIEEIIENKITEIYALYDTFANGEIKSIDELEEYCKGKDIEIGHLPKQMIAILKDEHKVMATEAERKQEEMLVDVQKSLESLDNQINEEIENVERKNSSLKSGKIASWLVNDMMRFQPVQKDNEGKPLNNSKANSTEYQLLQRTLAFFGSEHERLAPYFKQTKLIESSNPHPFLKDTEWEKCNNILSFYRSYLEAKKNFLESLKPEDWEKNQYFLKLKEPKTKPKTLVQGWKNGFNLPRGIFTEPIRKWFMKHRENITVAELKRVGLVAKVIPLFFSEEYKDSVQPFYNYHFNVGNINKPDEKNFLNCEERRELLRKKKDEFKKMTDKEKEENPSYLEFKSWNKFERELRLVRNQDIVTWLLCMELFNKKKIKELNVEKIYLKNINTNTTKKEKNTEEKNGEEKNIKEKNNILNRIMPMRLPIKVYGRENFSKNKKKKIRRNTFFTVYIEEKGTKLLKQGNFKALERDRRLGGLFSFVKTPSKAESKSNTISKLRVEYELGEYQKARIEIIKDMLALEKTLIDKYNSLDTDNFNKMLTDWLELKGEPDKASFQNDVDLLIAVRNAFSHNQYPMRNRIAFANINPFSLSSANTSEEKGLGIANQLKDKTHKTIEKIIEIEKPIETKE

SEQ ID NO: 55 - protein, 1120 aa, synthetic construct
  source 1..1120: note = Synthetic Peptide
MEDDKKTTDSIRYELKDKHFWAAFLNLARHNVYITVNHINKILEEDEINRDGYENTLENSWNEIKDINKKDRLSKLIIKHFPFLEATTYRQNPTDTTKQKEEKQAEAQSLESLKKSFFVFIYKLRDLRNHYSHYKHSKSLERPKFEEDLQNKMYNIFDVSIQFVKEDYKHNTDINPKKDFKHLDRKRKGKFHYSFADNEGNITESGLLFFVSLFLEKKDAIWVQKKLEGFKCSNKSYQKMTNEVFCRSRMLLPKLRLESTQTQDWILLDMLNELIRCPKSLYERLQGVNRKKFYVSFDPADEDYDAEQEPFKNTLVRHQDRFPYFALRYFDYNEVFANLRFQIDLGTYHFSIYKKLIGGQKEDRHLTHKLYGFERIQEFDKQNRPDEWKAIVKDSDTFKKKEEKEEEKPYISETTPHYHLENKKIGIAFKNHNIWPSTQTELTNNKRKKYNLGTSIKAEAFLSVHELLPMMFYYLLLKTENTKNDNKVGGKKETKKQGKHKIEAIIESKIKDIYALYDAFANGEINSEDELKEYLKGKDIKIVHLPKQMIAILKNEHKDMAEKAEAKQEKMKLATENRLKTLDKQLKGKIQNGKRYNSAPKSGEIASWLVNDMMRFQPVQKDENGESLNNSKANSTEYQLLQRTLAFFGSEHERLAPYFKQTKLIESSNPHPFLNDTEWEKCSNILSFYRSYLKARKNFLESLKPEDWEKNQYFLMLKEPKTNRETLVQGWKNGFNLPRGFFTEPIRKWFMEHWKSIKVDDLKRVGLVAKVTPLFFSEKYKDSVQPFYNYPFNVGDVNKPKEEDFLHREERIELWDKKKDKFKGYKAKKKFKEMTDKEKEEHRSYLEFQSWNKFERELRLVRNQDIVTWLLCTELIDKLKIDELNIKELKKLRLKDINTDTAKKEKNNILNRVMPMELPVTVYKVNKGGYIIKNKPLHTIYIKEAETKLLKQGNFKALVKDRRLNGLFSFVKTPSEAESESNPISKLRVEYELGKYQNARLDIIEDMLALEKKLIDKYNSLDTDNFHNMLTGWLELKGEAKKARFQNDVKLLTAVRNAFSHNQYPMYDENLFGNIERFSLSSSNIIESKGLDIAAKLKEEVSKAAKKIQNEEDNKKEKET

SEQ ID NO: 56 - protein, 1151 aa, synthetic construct
  source 1..1151: note = Synthetic Peptide
MEDKPFWAAFFNLARHNVYLTVNHINKLLDLEKLYDEGKHKEIFEREDIFNISDDVMNDANSNGKKRKLDIKKIWDDLDTDLTRKYQLRELILKHFPFIQPAIIGAQTKERTTIDKDKRSTSTSNDSLKQTGEGDINDLLSLSNVKSMFFRLLQILEQLRNYYSHVKHSKSATMPNFDEDLLNWMRYIFIDSVNKVKEDYSSNSVIDPNTSFSHLIYKDEQGKIKPCRYPFTSKDGSINAFGLLFFVSLFLEKQDSIWMQKKIPGFKKASENYMKMTNEVFCRNHILLPKIRLETVYDKDWMLLDMLNEVVRCPLSLYKRLTPAAQNKFKVPEKSSDNANRQEDDNPFSRILVRHQNRFPYFVLRFFDLNEVFTTLRFQINLGCYHFAICKKQIGDKKEVHHLIRTLYGFSRLQNFTQNTRPEEWNTLVKTTEPSSGNDGKTVQGVPLPYISYTIPHYQIENEKIGIKIFDGDTAVDTDIWPSVSTEKQLNKPDKYTLTPGFKADVFLSVHELLPMMFYYQLLLCEGMLKTDAGNAVEKVLIDTRNAIFNLYDAFVQEKINTITDLENYLQDKPILIGHLPKQMIDLLKGHQRDMLKAVEQKKAMLIKDTERRLKLLDKQLKQETDVAAKNTGTLLKNGQIADWLVNDMMRFQPVKRDKEGNPINCSKANSTEYQMLQRAFAFYATDSCRLSRYFTQLHLIHSDNSHLFLSRFEYDKQPNLIAFYAAYLKAKLEFLNELQPQNWASDNYFLLLRAPKNDRQKLAEGWKNGFNLPRGLFTEKIKTWFNEHKTIVDISDCDIFKNRVGQVARLIPVFFDKKFKDHSQPFYRYDFNVGNVSKPTEANYLSKGKREELFKSYQNKFKNNIPAEKTKEYREYKNFSLWKKFERELRLIKNQDILIWLMCKNLFDEKIKPKKDILEPRIAVSYIKLDSLQTNTSTAGSLNALAKVVPMTLAIHIDSPKPKGKAGNNEKENKEFTVYIKEEGTKLLKWGNFKTLLADRRIKGLFSYIEHDDIDLKQHPLTKRRVDLELDLYQTCRIDIFQQTLGLEAQLLDKYSDLNTDNFYQMLIGWRKKEGIPRNIKEDTDFLKDVRNAFSHNQYPDSKKIAFRRIRKFNPKELILEEEEGLGIATQMYKEVEKVVNRIKRIELFD

SEQ ID NO: 57 - protein, 1095 aa, synthetic construct
  source 1..1095: note = Synthetic Peptide
MEKPLLPNVYTLKHKFFWGAFLNIARHNAFITICHINEQLGLKTPSNDDKIVDVVCETWNNILNNDHDLLKKSQLTELILKHFPFLTAMCYHPPKKEGKKKGHQKEQQKEKESEAQSQAEALNPSKLIEALEILVNQLHSLRNYYSHYKHKKPDAEKDIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSEDLMLSKPIRKEIKKHGRVGFISRAITLYFKEKYQDKHQSFYNLSYKLEAKAPLLKREEHYEYWQQNKPQSPTESQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYHKTPIRTVYIREEHTKALKMGNFKALVKDRRLNGLFSFIKEENDTQKHPISQLRLRRELEIYQSLRVDAFKETLSLEEKLLNKHTSLSSLENEFRALLEEWKKEYAASSMVTDEHIAFIASVRNAFCHNQYPFYKEALHAPIPLFTVAQPTTEEKDGLGIAEALLKVLREYCEIVKSQI

SEQ ID NO: 58 - protein, 1224 aa, synthetic construct
  source 1..1224: note = Synthetic Peptide
MENKTSLGNNIYYNPFKPQDKSYFAGYFNAAMENTDSVFRELGKRLKGKEYTSENFFDAIFKENISLVEYERYVKLLSDYFPMARLLDKKEVPIKERKENFKKNFKGIIKAVRDLRNFYTHKEHGEVEITDEIFGVLDEMLKSTVLTVKKKKVKTDKTKEILKKSIEKQLDILCQKKLEYLRDTARKIEEKRRNQRERGEKELVAPFKYSDKRDDLIAAIYNDAFDVYIDKKKDSLKESSKAKYNTKSDPQQEEGDLKIPISKNGVVFLLSLFLTKQEIHAFKSKIAGFKATVIDEATVSEATVSHGKNSICFMATHEIFSHLAYKKLKRKVRTAEINYGEAENAEQLSVYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKENLISDRRIKEKITVFGRLSELEHKKALFIKNTETNEDREHYWEIFPNPNYDFPKENISVNDKDFPIAGSILDREKQPVAGKIGIKVKLLNQQYVSEVDKAVKAHQLKQRKASKPSIQNIIEEIVPINESNPKEAIVFGGQPTAYLSMNDIHSILYEFFDKWEKKKEKLEKKGEKELRKEIGKELEKKIVGKIQAQIQQIIDKDTNAKILKPYQDGNSTAIDKEKLIKDLKQEQNILQKLKDEQTVREKEYNDFIAYQDKNREINKVRDRNHKQYLKDNLKRKYPEAPARKEVLYYREKGKVAVWLANDIKRFMPTDFKNEWKGEQHSLLQKSLAYYEQCKEELKNLLPEKVFQHLPFKLGGYFQQKYLYQFYTCYLDKRLEYISGLVQQAENFKSENKVFKKVENECFKFLKKQNYTHKELDARVQSILGYPIFLERGFMDEKPTIIKGKTFKGNEALFADWFRYYKEYQNFQTFYDTENYPLVELEKKQADRKRKTKIYQQKKNDVFTLLMAKHIFKSVFKQDSIDQFSLEDLYQSREERLGNQERARQTGERNTNYIWNKTVDLKLCDGKITVENVKLKNVGDFIKYEYDQRVQAFLKYEENIEWQAFLIKESKEEENYPYVVEREIEQYEKVRREELLKEVHLIEEYILEKVKDKEILKKGDNQNFKYYILNGLLKQLKNEDVESYKVFNLNTEPEDVNINQLKQEATDLEQKAFVLTYIRNKFAHNQLPKKEFWDYCQEKYGKIEKEKTYAEYFAEVFKKEKEALIK

SEQ ID NO: 59 - protein, 1198 aa, synthetic construct
  source 1..1198: note = Synthetic Peptide
MKNIQRLGKGNEFSPFKKEDKFYFGGFLNLANNNIEDFFKEIITRFGIVITDENKKPKETFGEKILNEIFKKDISIVDYEKWVNIFADYFPFTKYLSLYLEEMQFKNRVICFRDVMKELLKTVEALRNFYTHYDHEPIKIEDRVFYFLDKVLLDVSLTVKNKYLKTDKTKEFLNQHIGEELKELCKQRKDYLVGKGKRIDKESEIINGIYNNAFKDFICKREKQDDKENHNSVEKILCNKEPQNKKQKSSATVWELCSKSSSKYTEKSFPNRENDKHCLEVPISQKGIVFLLSFFLNKGEIYALTSNIKGFKAKITKEEPVTYDKNSIRYMATHRMFSFLAYKGLKRKIRTSEINYNEDGQASSTYEKETLMLQMLDELNKVPDVVYQNLSEDVQKTFIEDWNEYLKENNGDVGTMEEEQVIHPVIRKRYEDKFNYFAIRFLDEFAQFPTLRFQVHLGNYLCDKRTKQICDTTTEREVKKKITVFGRLSELENKKAIFLNEREEIKGWEVFPNPSYDFPKENISVNYKDFPIVGSILDREKQPVSNKIGIRVKIADELQREIDKAIKEKKLRNPKNRKANQDEKQKERLVNEIVSTNSNEQGEPVVFIGQPTAYLSMNDIHSVLYEFLINKISGEALETKIVEKIETQIKQIIGKDATTKILKPYTNANSNSINREKLLRDLEQEQQILKTLLEEQQQREKDKKDKKSKRKHELYPSEKGKVAVWLANDIKRFMPKAFKEQWRGYHHSLLQKYLAYYEQSKEELKNLLPKEVFKHFPFKLKGYFQQQYLNQFYTDYLKRRLSYVNELLLNIQNFKNDKDALKATEKECFKFFRKQNYIINPINIQIQSILVYPIFLKRGFLDEKPTMIDREKFKENKDTELADWFMHYKNYKDNYQKFYAYPLEKVEEKEKFKRNKQINKQKKNDVYTLMMVEYIIQKIFGDKFVEENPLVLKGIFQSKAERQQNNTHAATTQERNLNGILNQPKDIKIQGKITVKGVKLKDIGNFRKYEIDQRVNTFLDYEPRKEWMAYLPNDWKEKEKQGQLPPNNVIDRQISKYETVRSKILLKDVQELEKIISDEIKEEHRHDLKQGKYYNFKYYILNGLLRQLKNENVENYKVFKLNTNPEKVNITQLKQEATDLEQKAFVLTYIRNKFAHNQLPKKEFWDYCQEKYGKIEKEKTYAEYFAEVFKREKEALIK

SEQ ID NO: 60 - protein, 1322 aa, synthetic construct
  REGION 1..1322: note = Synthetic Peptide
MSKECKKQRQEKKRRLQKANFSISLTGKHVFGAYFNMARTNFVKTINYILPIAGVRGNYSENQINKMLHALFLIQAGRNEELTTEQKQWEKKLRLNPEQQTKFQKLLFKHFPVLGPMMADVADHKAYLNKKKSTVQTEDETFAMLKGVSLADCLDIICLMADTLTECRNFYTHKDPYNKPSQLADQYLHQEMIAKKLDKVVVASRRILKDREGLSVNEVEFLTGIDHLHQEVLKDEFGNAKVKDGKVMKTFVEYDDFYFKISGKRLVNGYTVTTKDDKPVNVNTMLPALSDFGLLYFCVLFLSKPYAKLFIDEVRLFEYSPFDDKENMIMSEMLSIYRIRTPRLHKIDSHDSKATLAMDIFGELRRCPMELYNLLDKNAGQPFFHDEVKHPNSHTPDVSKRLRYDDRFPTLALRYIDETELFKRIRFQLQLGSFRYKFYDKENCIDGRVRVRRIQKEINGYGRMQEVADKRMDKWGDLIQKREERSVKLEHEELYINLDQFLEDTADSTPYVTDRRPAYNIHANRIGLYWEDSQNPKQYKVFDENGMYIPELVVTEDKKAPIKMPAPRCALSVYDLPAMLFYEYLREQQDNEFPSAEQVIIEYEDDYRKFFKAVAEGKLKPFKRPKEFRDFLKKEYPKLRMADIPKKLQLFLCSHGLCYNNKPETVYERLDRLTLQHLEERELHIQNRLEHYQKDRDMIGNKDNQYGKKSFSDVRHGALARYLAQSMMEWQPTKLKDKEKGHDKLTGLNYNVLTAYLATYGHPQVPEEGFTPRTLEQVLINAHLIGGSNPHPFINKVLALGNRNIEELYLHYLEEELKHIRSRIQSLSSNPSDKALSALPFIHHDRMRYHERTSEEMMALAARYTTIQLPDGLFTPYILEILQKHYTENSDLQNALSQDVPVKLNPTCNAAYLITLFYQTVLKDNAQPFYLSDKTYTRNKDGEKAESFSFKRAYELFSVLNNNKKDTFPFEMIPLFLTSDEIQERLSAKLLDGDGNPVPEVGEKGKPATDSQGNTIWKRRIYSEVDDYAEKLTDRDMKISFKGEWEKLPRWKQDKIIKRRDETRRQMRDELLQRMPRYIRDIKDNERTLRRYKTQDMVLFLLAEKMFTNIISEQSSEFNWKQMRLSKVCNEAFLRQTLTFRVPVTVGETTIYVEQENMSLKNYGEFYRFLTDDRLMSLLNNIVETLKPNENGDLVIRHTDLMSELAAYDQYRSTIFMLIQSIENLIITNNAVLDDPDADGFWVREDLPKRNNFASLLELINQLNNVELTDDERKLLVAIRNAFSHNSYNIDFSLIKDVKHLPEVAKGILQHLQSMLGVEITK

SEQ ID NO: 61 - protein, 1090 aa, synthetic construct; identical to SEQ ID NO: 29
  REGION 1..1090: note = Synthetic Peptide

SEQ ID NO: 62 - protein, 849 aa, synthetic construct
  REGION 1..849: note = Synthetic Peptide
MNDKSTWQLKLHRIVRWSFLRRQRVGCDISHHFDFILVRRSGIKNMEFENIKKTSNKEVYSIEQYEGEKKWCFAIVLNRAQTNLEENPKLFEQTLTRFEKIMKQDWFNEETKKLIYEKEEENKVKEEIQIAASERLKNLRNYFSHYLHAPDCLIFNRNDTIRIIMEKAYEKSRFEAKKKQQEDISIEFPELFEEEDKITSAGVVFFVSFFIERRFLNRLMGYVQGFRKTEGEYNITRQVFSKYCLKDSYSVQAQDHDAVMFRDILGYLSRVPTEIYQHIKLTRKRSQDQLSERKTDKFILFALKYLEDYGLKDLADYTACFARSKIKRENEDTKETDGNKHKFHREKPVVEIHFDKEKQDQFYIKRNNVILKAQKKGGQSNVFRMGVYELKYLVLLSLLGKAEEAIQRIDRYISSLKKQLPYLDKISNEEIQKSINFLPRFVRSRLGLLQVDDEKRLKTRLEYVKAKWTDKKEGSRKLELHRKGRDILRYINERCDRPLSRKEYNNILKFIVNKDFAGFYNELEELKRTRRLDKNIIQKLSGHTTLNALHERVCDLVLQELGSLQSENLKEYIGLIPKEEKEVTFREKVDRILEQPVVYKGFLRYEFFKEDKKSFARLVEEAIKTKWSDFDIPLGEEYYNIPSLDRFDRTNKKLYETLAMDRLCLMMARQYYLRLNEKLAEKAQHIYWKKEDGREVIIFKFQNPKEQKKSFSIRFSILDYTKMYVMDDPEFLSRLWEYFIPKEAKEIDYHKHYARAFDKYTNLQKEGIDAILKLEGRIIERRKIKPAKNYIEFQEIMNRSGYNNDQQVALKRVRNALLHYNLNFEREHLKRFYGVVKREGIEKKWSLIV

SEQ ID NO: 63 - protein, 950 aa, synthetic construct
  REGION 1..950: note = Synthetic Peptide
MSNEIGAFREHQFAYAPGNEKQEEATFATYFNLALEGMMFGEVESNPDKIEKSLDTLPPAILRQIASFIWLSKEDHPDKAYSTEEVKVIVTDLVRRLCFYRNYFSHCFYLDTQYFYSDELVDTTAIGEKLPYNFHHFITNRLFRYSLPEITLFRWNEGERKYEILRDGLIFFCCLFLKRGQAERFLNELRFFKRTDEEGRIKRTIFTKYCTRESHKHIGIEEQDFLIFQDIIGDLNRVPKVCDGVVDLSKENERYIKNRETSNESDENKARYRLLIREKDKFPYYLMRYIVDFGVLPCITFKQNDYSTKEGRGQFHYQDAAVAQEERCYNFVVRNGNVYYSYMPQAQNVVRISELQGTISVEELRNMVYASINGKDVNKSVEQYLYHLHLLYEKILTISGQTIKEGRVDVEDYRPLLDKLLLRPASNGEELRRELRKLLPKRVCDLLSNRFDCSEGVSAVEKRLKAILLRHEQLLLSQNPALHIDKIKSVIDYLYLFFSDDEKFRQQPTEKAHRGLKDEEFQMYHYLVGDYDSHPLALWKELEASGRLKPEMRKLTSATSLHGLYMLCLKGTVEWCRKQLMSIGKGTAKVEAIADRVGLKLYDKLKEYTPEQLEREVKLVVMHGYAAAATPKPKAQAAIPSKLTELRFYSFLGKREMSFAAFIRQDKKAQKLWLRNFYTVENIKTLQKRQAAADAACKKLYNLVGEVERVHTNDKVLVLVAQRYRERLLNVGSKCAVTLDNPERQQKLADVYEVQNAWLSIRFDDLDFTLTHVNLSNLRKAYNLIPRKHILAFKEYLDNRVKQKLCEECRNVRRKEDLCTCCSPRYSNLTSWLKENHSESSIEREAATMMLLDVERKLLSFLLDERRKAIIEYGKFIPFSALVKECRLADAGLCGIRNDVLHDNVISYADAIGKLSAYFPKEASEAVEYIRRTKEVREQRREELMANSSQ

SEQ ID NO: 64 - protein, 1148 aa, synthetic construct
  REGION 1..1148: note = Synthetic Peptide
MENLNKILDKENEICISKIFNTKGIAAPITEKALDNIKQKNDLNKEARLHYFSIGHSFKQIDTKKVFDYVLIEELKDEKPLKFITLQKDFFTKEFSIKLQKLINSIRNINNHYVHNFNDINLNKIDSNVFHFLKESFELAIIEKYYKVNKKYPLDNEIVLFLKELFIKDENTALLNYFTNLSKDEAIEYILTFTITENKIWNINNEHNILNIEKGKYLTFEAMLFLITIFLYKNEANHLLPKLYDFKNNKSKQELFTFFSKKFTSQDIDAEEGHLIKFRDMIQYLNHYPTAWNNDLKLESENKNKIMTTKLIDSIIEFELNSNYPSFATDIQFKKEAKAFLFASNKKRNQTSFSNKSYNEEIRHNPHIKQYRDEIASALTPISFNVKEDKFKIFVKKHVLEEYFPNSIGYEKFLEYNDFTEKEKEDFGLKLYSNPKTNKLIERIDNHKLVKSHGRNQDRFMDFSMRFLAENNYFGKDAFFKCYKFYDTQEQDEFLQSNENNDDVKFHKGKVTTYIKYEEHLKNYSYWDCPFVEENNSMSVKISIGSEEKILKIQRNLMIYFLENALYNENVENQGYKLVNNYYRELKKDVEESIASLDLIKSNPDFKSKYKKILPKRLLHNYAPAKQDKAPENAFETLLKKADFREEQYKKLLKKAEHEKNKEDFVKRNKGKQFKLHFIRKACQMMYFKEKYNTLKEGNAAFEKKDPVIEKRKNKEHEFGHHKNLNITREEFNDYCKWMFAFNGNDSYKKYLRDLFSEKHFFDNQEYKNLFESSVNLEAFYAKTKELFKKWIETNKPTNNENRYTLENYKNLILQKQVFINVYHFSKYLIDKNLLNSENNVIQYKSLENVEYLISDFYFQSKLSIDQYKTCGKLFNKLKSNKLEDCLLYEIAYNYIDKKNVHKIDIQKILTSKIILTINDANTPYKISVPFNKLERYTEMIAIKNQNNLKARFLIDLPLYLSKNKIKKGKDSAGYEIIIKNDLEIEDINTINNKIINDSVKFTEVLMELEKYFILKDKCILSKNYIDNSEIPSLKQFSKVWIKENENEIINYRNIACHFHLPLLETFDNLLLNVEQKFIKEELQNVSTINDLSKPQEYLILLFIKFKHNNFYLNLFNKNESKTIKNDKEVKKNRVLQKFINQVILKKK

SEQ ID NO: 65 - RNA, 36 nt, synthetic construct
  misc_feature 1..36: note = Synthetic Oligonucleotide
  source 1..36: mol_type = other RNA
ggctgtctgatctgcctgtcccacatcaatcgcacg

SEQ ID NO: 66 - RNA, 66 nt, synthetic construct
  misc_feature 1..66: note = Synthetic Oligonucleotide
  source 1..66: mol_type = other RNA
gtgctagggatgggggacagtcagatcatagttgtggaaggtccagttttgggggctattacaaca

SEQ ID NO: 67 - RNA, 15 nt, synthetic construct
  misc_feature 1..15: note = Synthetic Oligonucleotide
  source 1..15: mol_type = other RNA
ttccccacattcgac

SEQ ID NO: 68 - RNA, 15 nt, synthetic construct
  misc_feature 1..15: note = Synthetic Oligonucleotide
  source 1..15: mol_type = other RNA
ggccaatgtggggaa

SEQ ID NO: 69 - protein, 17 aa, synthetic construct
  REGION 1..17: note = Synthetic Peptide
PEADPGSAAPYLKTKFI

SEQ ID NO: 70 - DNA, 57 bp, synthetic construct
  misc_feature 1..57: note = Synthetic Oligonucleotide
  source 1..57: mol_type = other DNA
agcatcctgaagctgacccaggtagcgctgccccatacctgaagaccaagtttatct

SEQ ID NO: 71 - DNA, 51 bp, synthetic construct
  misc_feature 1..51: note = Synthetic Oligonucleotide
  source 1..51: mol_type = other DNA
gaaacttggtcttcaggcatggggcagcgctacctgggtcagcttcaggat

SEQ ID NO: 72 - protein, 17 aa, synthetic construct
  REGION 1..17: note = Synthetic Peptide
TCSNTIDLPMSPRTLDS

SEQ ID NO: 73 - DNA, 57 bp, synthetic construct
  misc_feature 1..57: note = Synthetic Oligonucleotide
  source 1..57: mol_type = other DNA
caacgacctgcagcaataccattgacctgccgatgtccccccgcactttagattcat

SEQ ID NO: 74 - DNA, 31 bp, synthetic construct
  misc_feature 1..31: note = Synthetic Oligonucleotide
  source 1..31: mol_type = other DNA
gtgcgggggcacatcggcaggtcaatggtat

SEQ ID NO: 75 - protein, 17 aa, synthetic construct
  REGION 1..17: note = Synthetic Peptide
DSGIHSGATTTAPSLSG

SEQ ID NO: 76 - DNA, 57 bp, synthetic construct
  misc_feature 1..57: note = Synthetic Oligonucleotide
  source 1..57: mol_type = other DNA
tacctggactctggaatccattctggtgccactaccacagctccttctctgagtggt

SEQ ID NO: 77 - DNA, 31 bp, synthetic construct
  misc_feature 1..31: note = Synthetic Oligonucleotide
  source 1..31: mol_type = other DNA
gaggagctgtgttagtggcaccagaatggat

SEQ ID NO: 78 - skipped

SEQ ID NO: 79 - protein, 15 aa, synthetic construct
  REGION 1..15: note = Synthetic Peptide
GGGGSGGGGSGGGGS

SEQ ID NO: 80 - protein, 6 aa, unidentified
  source 1..6: note = Simian virus 40
PKKKRK

SEQ ID NO: 81 - protein, 16 aa, Homo sapiens
KRPAATKKAGQAKKKK

SEQ ID NO: 82 - protein, 8 aa, Homo sapiens
PAAKRVKL

SEQ ID NO: 83 - protein, 11 aa, Homo sapiens
RQRRNELKRSP

SEQ ID NO: 84 - protein, 38 aa, Homo sapiens
NQSSNFGPMKGGNFGGRSSGPYGGGGQYFAKPRNQGGY

SEQ ID NO: 85 - protein, 42 aa, Homo sapiens
RMRIZFKNKGKDTAELRRRRVEVSVELRKAKKDEQILKRRNV

SEQ ID NO: 86 - protein, 8 aa, Homo sapiens
VSRKRPRP

SEQ ID NO: 87 - protein, 8 aa, Homo sapiens
PPKKARED

SEQ ID NO: 88 - protein, 8 aa, Homo sapiens
PQPKKKPL

SEQ ID NO: 89 - protein, 12 aa, Mus musculus
SALIKKKKKMAP

SEQ ID NO: 90 - protein, 5 aa, unidentified
  source 1..5: note = Influenza virus
DRLRR

SEQ ID NO: 91 - protein, 7 aa, unidentified
  source 1..7: note = Influenza virus
PKQKKRK

SEQ ID NO: 92 - protein, 10 aa, unidentified
  source 1..10: note = Hepatitis delta virus
RKLKKKIKKL

SEQ ID NO: 93 - protein, 10 aa, Mus musculus
REKKKFLKRR

SEQ ID NO: 94 - protein, 20 aa, Homo sapiens
KRKGDEVDGVDEVAKKKSKK

SEQ ID NO: 95 - protein, 17 aa, Homo sapiens
RKCLQAGMNLEARKTKK

SEQ ID NO: 96 - protein, 15 aa, synthetic construct
  VARIANT 4: note = Xaa can be any naturally occurring amino acid
DKHXFGAFLNLARHN

SEQ ID NO: 97 - protein, 12 aa, synthetic construct
  REGION 1..12: note = Synthetic Peptide
GLLFFVSLFLDK

SEQ ID NO: 98 - protein, 7 aa, synthetic construct
  VARIANT 4: note = Xaa can be any naturally occurring amino acid
SKIXGFK

SEQ ID NO: 99 - protein, 10 aa, synthetic construct
  VARIANT 7: note = Xaa can be any naturally occurring amino acid
DMLNELXRCP

SEQ ID NO: 100 - protein, 15 aa, synthetic construct
  VARIANT 2: note = Xaa can be any naturally occurring amino acid
  VARIANT 14: note = Xaa can be any naturally occurring amino acid
RXZDRFPYFALRYXD

SEQ ID NO: 101 - protein, 10 aa, synthetic construct
  VARIANT 9: note = Xaa can be any naturally occurring amino acid
LRFQVBLGXY

SEQ ID NO: 102 - protein, 10 aa, synthetic construct
  REGION 1..10: note = Synthetic Peptide
GLLFFVSLFL

SEQ ID NO: 103 - protein, 9 aa, synthetic construct
  SITE 4: note = Xaa can be any naturally occurring amino acid
RHQXRFPYF

SEQ ID NO: 104 - protein, 8 aa, synthetic construct
  REGION 1..8: note = Synthetic Peptide
RHQDRFPY

SEQ ID NO: 105 - protein, 1224 aa, Bergeyella zoohelcum; identical to SEQ ID NO: 58

SEQ ID NO: 106 - protein, 1126 aa, Prevotella intermedia; identical to SEQ ID NO: 54

SEQ ID NO: 107 - protein, 1127 aa, Prevotella buccae; identical to SEQ ID NO: 51

SEQ ID NO: 108 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFAVFFKPDDFVLAKNRKEQLISVADGKECLTVSGFAFFICLFLDREQASGMLSRIRGFKRTDENWARAVHETFCDLCIRHPHDRLESSNTKEALLLDMLNELNRCPRILYDMLPEEERAQFLPALDENSMNNLSENSLDEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELRLLDPSSGHPFLSATMETAHRYTEGFYKCYLEKKREWLAKIFYRPEQDENTKRRISVFFVPDGEARKLLPLLIRRRMKEQNDLQDWIRNKQAHPIDLPSHLFDSKVMELLKVKDGKKKWNEAFKDWWSTKYPDGMQPFYGLRRELNIHGKSVSYIPSDGKKFADCYTHLMEKTVRDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 109 - protein, 1115 aa, unidentified
  source 1..1115: note = Bacteroides pyogenes
MESIKNSQKSTGKTLQKDPPYFGLYLNMALLNVRKVENHIRKWLGDVALLPEKSGFHSLLTTDNLSSAKWTRFYYKSRKFLPFLEMFDSDKKSYENRRETAECLDTIDRQKISSLLKEVYGKLQDIRNAFSHYHIDDQSVKHTALIISSEMHRFIENAYSFALQKTRARFTGVFVETDFLQAEEKGDNKKFFAIGGNEGIKLKDNALIFLICLFLDREEAFKFLSRATGFKSTKEKGFLAVRETFCALCCRQPHERLLSVNPREALLMDMLNELNRCPDILFEMLDEKDQKSFLPLLGEEEQAHILENSLNDELCEAIDDPFEMIASLSKRVRYKNRFPYLMLRYIEEKNLLPFIRFRIDLGCLELASYPKKMGEENNYERSVTDHAMAFGRLTDFHNEDAVLQQITKGITDEVRFSLYAPRYAIYNNKIGFVRTSGSDKISFPTLKKKGGEGHCVAYTLQNTKSFGFISIYDLRKILLLSFLDKDKAKNIVSGLLEQCEKHWKDLSENLFDAIRTELQKEFPVPLIRYTLPRSKGGKLVSSKLADKQEKYESEFERRKEKLTEILSEKDFDLSQIPRRMIDEWLNVLPTSREKKLKGYVETLKLDCRERLRVFEKREKGEHPLPPRIGEMATDLAKDIIRMVIDQGVKQRITSAYYSEIQRCLAQYAGDDNRRHLDSIIRELRLKDTKNGHPFLGKVLRPGLGHTEKLYQRYFEEKKEWLEATFYPAASPKRVPRFVNPPTGKQKELPLIIRNLMKERPEWRDWKQRKNSHPIDLPSQLFENEICRLLKDKIGKEPSGKLKWNEMFKLYWDKEFPNGMQRFYRCKRRVEVFDKVVEYEYSEEGGNYKKYYEALIDEVVRQKISSSKEKSKLQVEDLTLSVRRVFKRAINEKEYQLRLLCEDDRLLFMAVRDLYDWKEAQLDLDKIDNMLGEPVSVSQVIQLEGGQPDAVIKAECKLKDVSKLMRYCYDGRVKGLMPYFANHEATQEQVEMELRHYEDHRRRVFNWVFALEKSVLKNEKLRRFYEESQGGCEHRRCIDALRKASLVSEEEYEFLVHIRNKSAHNQFPDLEIGKLPPNVTSGFCECIWSKYKAIICRIIPFIDPERRFFGKLLEQK

SEQ ID NO: 110 - protein, 953 aa, unidentified
  source 1..953: note = Alistipes sp.
MSNEIGAFREHQFAYAPGNEKQEEATFATYFNLALSNVEGMMFGEVESNPDKIEKSLDTLPPAILRQIASFIWLSKEDHPDKAYSTEEVKVIVTDLVRRLCFYRNYFSHCFYLDTQYFYSDELVDTTAIGEKLPYNFHHFITNRLFRYSLPEITLFRWNEGERKYEILRDGLIFFCCLFLKRGQAERFLNELRFFKRTDEEGRIKRTIFTKYCTRESHKHIGIEEQDFLIFQDIIGDLNRVPKVCDGVVDLSKENERYIKNRETSNESDENKARYRLLIREKDKFPYYLMRYIVDFGVLPCITFKQNDYSTKEGRGQFHYQDAAVAQEERCYNFVVRNGNVYYSYMPQAQNVVRISELQGTISVEELRNMVYASINGKDVNKSVEQYLYHLHLLYEKILTISGQTIKEGRVDVEDYRPLLDKLLLRPASNGEELRRELRKLLPKRVCDLLSNRFDCSEGVSAVEKRLKAILLRHEQLLLSQNPALHIDKIKSVIDYLYLFFSDDEKFRQQPTEKAHRGLKDEEFQMYHYLVGDYDSHPLALWKELEASGRLKPEMRKLTSATSLHGLYMLCLKGTVEWCRKQLMSIGKGTAKVEAIADRVGLKLYDKLKEYTPEQLEREVKLVVMHGYAAAATPKPKAQAAIPSKLTELRFYSFLGKREMSFAAFIRQDKKAQKLWLRNFYTVENIKTLQKRQAAADAACKKLYNLVGEVERVHTNDKVLVLVAQRYRERLLNVGSKCAVTLDNPERQQKLADVYEVQNAWLSIRFDDLDFTLTHVNLSNLRKAYNLIPRKHILAFKEYLDNRVKQKLCEECRNVRRKEDLCTCCSPRYSNLTSWLKENHSESSIEREAATMMLLDVERKLLSFLLDERRKAIIEYGKFIPFSALVKECRLADAGLCGIRNDVLHDNVISYADAIGKLSAYFPKEASEAVEYIRRTKEVREQRREELMANSSQ

SEQ ID NO: 111 - protein, 1322 aa, unidentified; identical to SEQ ID NO: 60
  source 1..1322: note = Prevotella sp.

SEQ ID NO: 112 - protein, 1322 aa, unidentified; identical to SEQ ID NO: 60
  source 1..1322: note = Prevotella sp.

SEQ ID NO: 113 - protein, 1095 aa, Riemerella anatipestifer; identical to SEQ ID NO: 57

SEQ ID NO: 114 - protein, 1124 aa, unidentified
  source 1..1124: note = Prevotella aurantiaca
MEDDKKTTGSISYELKDKHFWAAFLNLARHNVYITINHINKLLEIREIDNDEKVLDIKTLWQKGNKDLNQKARLRELMTKHFPFLETAIYTKNKEDKKEVKQEKQAEAQSLESLKDCLFLFLDKLQEARNYYSHYKYSEFSKEPEFEEGLLEKMYNIFGNNIQLVINDYQHNKDINPDEDFKHLDRKGQFKYSFADNEGNITESGLLFFVSLFLEKKDAIWMQQKLNGFKDNLENKKKMTHEVFCRSRILMPKLRLESTQTQDWILLDMLNELIRCPKSLYERLQGDDREKFKVPFDPADEDYNAEQEPFKNTLIRHQDRFPYFVLRYFDYNEIFKNLRFQIDLGTYHFSIYKKLIGGQKEDRHLTHKLYGFERIQEFAKQNRPDEWKAIVKDLDTYETSNKRYISETTPHYHLENQKIGIRFRNGNKEIWPSLKTNDENNEKSKYKLDKQYQAEAFLSVHELLPMMFYYLLLKKEKPNNDEINASIVEGFIKREIRNIFKLYDAFANGEINNIDDLEKYCADKGIPKRHLPKQMVAILYDEHKDMVKEAKRKQKEMVKDTKKLLATLEKQTQKEKEDDGRNVKLLKSGEIARWLVNDMMRFQPVQKDNEGKPLNNSKANSTEYQMLQRSLALYNNEEKPTRYFRQVNLIESNNPHPFLKWTKWEECNNILTFYYSYLTKKIEFLNKLKPEDWKKNQYFLKLKEPKTNRETLVQGWKNGFNLPRGIFTEPIREWFKRHQNNSKEYEKVEALDRVGLVTKVIPLFFKEEYFKDKEENFKEDTQKEINDCVQPFYNFPYNVGNIHKPKEKDFLHREERIELWDKKKDKFKGYKEKIKSKKLTEKDKEEFRSYLEFQSWNKFERELRLVRNQDIVTWLLCKELIDKLKIDELNIEELKKLRLNNIDTDTAKKEKNNILNRVMPMELPVTVYEIDDSHKIVKDKPLHTIYIKEAETKLLKQGNFKALVKDRRLNGLFSFVKTNSEAESKRNPISKLRVEYELGEYQEARIEIIQDMLALEEKLINKYKDLPTNKFSEMLNSWLEGKDEADKARFQNDVDFLIAVRNAFSHNQYPMHNKIEFANIKPFSLYTANNSEEKGLGIANQLKDKTKETTDKIKKIEKPIETKE

SEQ ID NO: 115 - protein, 1151 aa, unidentified; identical to SEQ ID NO: 56
  source 1..1151: note = Prevotella saccharolytica

SEQ ID NO: 116 - protein, 1159 aa, unidentified
  source 1..1159: note = Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSDIVIENKVLDFLNSSFVSTALHVKDKYLKTDKTKEFLKETIAAELDILIEAYKKKQIEKKNTRFKANKREDILNAIYNEAFWSFINDKDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHTELQKLFAYFDTSKSDLELILSNMVMVKDYPIELIDLVKKSRTLVDFLNKYLEARLEYIENVITRVKNSIGTPQFKTVRKECFTFLKKSNYTVVSLDKQVERILSMPLFIERGFMDDKPTMLEGKSYKQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCDGLVHIDNVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLLPIGMDVREMLILSTDVKFKKEEIIQLGQAGEVEQDLYSLIYIRNKFAHNQLPIKEFFDFCENNYRSISDNEYYAEYYMEIFRSIKEKYAN

SEQ ID NO: 117 - protein, 1120 aa, Prevotella intermedia; identical to SEQ ID NO: 55

SEQ ID NO: 118 - protein, 1199 aa, Capnocytophaga canimorsus
MKNIQRLGKGNEFSPFKKEDKFYFGGFLNLANNNIEDFFKEIITRFGIVITDENKKPKETFGEKILNEIFKKDISIVDYEKWVNIFADYFPFTKYLSLYLEEMQFKNRVICFRDVMKELLKTVEALRNFYTHYDHEPIKIEDRVFYFLDKVLLDVSLTVKNKYLKTDKTKEFLNQHIGEELKELCKQRKDYLVGKGKRIDKESEIINGIYNNAFKDFICKREKQDDKENHNSVEKILCNKEPQNKKQKSSATVWELCSKSSSKYTEKSFPNRENDKHCLEVPISQKGIVFLLSFFLNKGEIYALTSNIKGFKAKITKEEPVTYDKNSIRYMATHRMFSFLAYKGLKRKIRTSEINYNEDGQASSTYEKETLMLQMLDELNKVPDVVYQNLSEDVQKTFIEDWNEYLKENNGDVGTMEEEQVIHPVIRKRYEDKFNYFAIRFLDEFAQFPTLRFQVHLGNYLCDKRTKQICDTTTEREVKKKITVFGRLSELENKKAIFLNEREEIKGWEVFPNPSYDFPKENISVNYKDFPIVGSILDREKQPVSNKIGIRVKIADELQREIDKAIKEKKLRNPKNRKANQDEKQKERLVNEIVSTNSNEQGEPVVFIGQPTAYLSMNDIHSVLYEFLINKISGEALETKIVEKIETQIKQIIGKDATTKILKPYTNANSNSINREKLLRDLEQEQQILKTLLEEQQQREKDKKDKKSKRKHELYPSEKGKVAVWLANDIKRFMPKAFKEQWRGYHHSLLQKYLAYYEQSKEELKNLLPKEVFKHFPFKLKGYFQQQYLNQFYTDYLKRRLSYVNELLLNIQNFKNDKDALKATEKECFKFFRKQNYIINPINIQIQSILVYPIFLKRGFLDEKPTMIDREKFKENKDTELADWFMHYKNYKEDNYQKFYAYPLEKVEEKEKFKRNKQINKQKKNDVYTLMMVEYIIQKIFGDKFVEENPLVLKGIFQSKAERQQNNTHAATTQERNLNGILNQPKDIKIQGKITVKGVKLKDIGNFRKYEIDQRVNTFLDYEPRKEWMAYLPNDWKEKEKQGQLPPNNVIDRQISKYETVRSKILLKDVQELEKIISDEIKEEHRHDLKQGKYYNFKYYILNGLLRQLKNENVENYKVFKLNTNPEKVNITQLKQEATDLEQKAFVLTYIRNKFAHNQLPKKEFWDYCQEKYGKIEKEKTYAEYFAEVFKREKEALIK

SEQ ID NO: 119 - protein, 1175 aa, unidentified; identical to SEQ ID NO: 49
  source 1..1175: note = Porphyromonas gulae

SEQ ID NO: 120 - protein, 1090 aa, Prevotella sp.; identical to SEQ ID NO: 29

SEQ ID NO: 121 - protein, 1150 aa, Flavobacterium branchiophilum
MENLNKILDKENEICISKIFNTKGIAAPITEKALDNIKSKQKNDLNKEARLHYFSIGHSFKQIDTKKVFDYVLIEELKDEKPLKFITLQKDFFTKEFSIKLQKLINSIRNINNHYVHNFNDINLNKIDSNVFHFLKESFELAIIEKYYKVNKKYPLDNEIVLFLKELFIKDENTALLNYFTNLSKDEAIEYILTFTITENKIWNINNEHNILNIEKGKYLTFEAMLFLITIFLYKNEANHLLPKLYDFKNNKSKQELFTFFSKKFTSQDIDAEEGHLIKFRDMIQYLNHYPTAWNNDLKLESENKNKIMTTKLIDSIIEFELNSNYPSFATDIQFKKEAKAFLFASNKKRNQTSFSNKSYNEEIRHNPHIKQYRDEIASALTPISFNVKEDKFKIFVKKHVLEEYFPNSIGYEKFLEYNDFTEKEKEDFGLKLYSNPKTNKLIERIDNHKLVKSHGRNQDRFMDFSMRFLAENNYFGKDAFFKCYKFYDTQEQDEFLQSNENNDDVKFHKGKVTTYIKYEEHLKNYSYWDCPFVEENNSMSVKISIGSEEKILKIQRNLMIYFLENALYNENVENQGYKLVNNYYRELKKDVEESIASLDLIKSNPDFKSKYKKILPKRLLHNYAPAKQDKAPENAFETLLKKADFREEQYKKLLKKAEHEKNKEDFVKRNKGKQFKLHFIRKACQMMYFKEKYNTLKEGNAAFEKKDPVIEKRKNKEHEFGHHKNLNITREEFNDYCKWMFAFNGNDSYKKYLRDLFSEKHFFDNQEYKNLFESSVNLEAFYAKTKELFKKWIETNKPTNNENRYTLENYKNLILQKQVFINVYHFSKYLIDKNLLNSENNVIQYKSLENVEYLISDFYFQSKLSIDQYKTCGKLFNKLKSNKLEDCLLYEIAYNYIDKKNVHKIDIQKILTSKIILTINDANTPYKISVPFNKLERYTEMIAIKNQNNLKARFLIDLPLYLSKNKIKKGKDSAGYEIIIKNDLEIEDINTINNKIINDSVKFTEVLMELEKYFILKDKCILSKNYIDNSEIPSLKQFSKVWIKENENEIINYRNIACHFHLPLLETFDNLLLNVEQKFIKEELQNVSTINDLSKPQEYLILLFIKFKHNNFYLNLFNKNESKTIKNDKEVKKNRVLQKFINQVILKKK

SEQ ID NO: 122 - protein, 1159 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSDIVIENKVLDFLNSSFVSTALHVKDKYLKTDKTKEFLKETIAAELDILIEAYKKKQIEKKNTRFKANKREDILNAIYNEAFWSFINDKDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVTHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHIELQKLFAYFDTSKSDLELILSNMVMVKDYPIELIDLVKKSRTLVDFLNKYLEARLEYIENVITRVKNSIGTPQFKTVRKECFTFLKKSNYTVVSLDKQVERILSMPLFIERGFMDDKPTMLEGKSYKQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCDGLVHIDNVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLLPIGMDVREMLILSTDVKFKKEEIIQLGQAGEVEQDLYSLIYIRNKFAHNQLPIKEFFDFCENNYRSISDNEYYAEYYMEIFRSIKEKYAN

SEQ ID NO: 123 - protein, 1214 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLIPFLEENKTDDKQNKTVSLRKYRKSKPNEETSITLTQSGLVFLMSFFLHRKEFQVFTSGLERFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLSLVTEYKKNVYLKETSNIDLSRFPLFPNPSYVMANNNIPFYIDSRSNNLDEYLNQKKKAQSQNKKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLIKTINTDSSVTFENQPIDIPRLKNALQKELTLTQEKLLNVKEHEIEVDNYNRNKNTYKFKNQPKNKVDDKKLQRKYVFYRNEIRQEANWLASDLIHFMKNKSLWKGYMHNELQSFLAFFEDKKNDCIALLETVFNLKEDCILTKGLKNLFLKHGNFIDFYKEYLKLKEDFLSTESTFLENGFIGLPPKILKKELSKRLKYIFIVFQKRQFIIKELEEKKNNLYADAINLSRGIFDEKPTMIPFKKPNPDEFASWFVASYQYNNYQSFYELTPDIVERDKKKKYKNLRAINKVKIQDYYLKLMVDTLYQDLFNQPLDKSLSDFYVSKAEREKIKADAKAYQKLNDSSLWNKVIHLSLQNNRITANPKLKDIGKYKRALQDEKIATLLTYDARTWTYALQKPEKENENDYKELHYTALNMELQEYEKVRSKELLKQVQELEKKILDKFYDFSNNASHPEDLEIEDKKGKRHPNFKLYITKALLKNESEIINLENIDIEILLKYYDYNTEELKEKIKNMDEDEKAKIINTKENYNKITNVLIKKALVLIIIRNKMAHNQYPPKFIYDLANRFVPKKEEEYFATYFNRVFETITKELWENKEKKDKTQV

SEQ ID NO: 124 - protein, 1119 aa, Porphyromonas gingivalis; identical to SEQ ID NO: 50

SEQ ID NO: 125 - protein, 1175 aa, Porphyromonas sp.
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRTDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIGILSQERKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKGEFHLPRGIFTEAVRDCLIEMGYDEVGSYREVGFMAKAVPLYFERACEDRVQPFYDSPFNVGNSLKPKKGRFLSKEDRAEEWERGKERFRDLEAWSHSAARRIKDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 126 - protein, 1132 aa, Prevotella intermedia; identical to SEQ ID NO: 53

SEQ ID NO: 127 - protein, 1134 aa, Prevotella intermedia
MKMEDDKKTKESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAKAQSFDSLKHCLFLFLEKLQEARNYYSHYKYSESTKEPMLEKELLKKMYNIFDDNIQLVIKDYQHNKDINPDEDFKHLDRTEEEFNYYFTTNKKGNITASGLLFFVSLFLEKKDAIWMQQKLRGFKDNRESKKKMTHEVFCRSRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRTDEWKAIVKDFDTYETSEEPYISETAPHYHLENQKIGIRFRNDNDEIWPSLKTNGENNEKRKYKLDKQYQAEAFLSVHELLPMMFYYLLLKKEEPNNDKKNASIVEGFIKREIRDIYKLYDAFANGEINNIDDLEKYCEDKGIPKRHLPKQMVAILYDEHKDMAEEAKRKQKEMVKDTKKLLATLEKQTQGEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSEEYEKVETLDRVGLVTKVIPLFFKKEDSKDKEEYLKKDAQKEINNCVQPFYGFPYNVGNIHKPDEKDFLPSEERKKLWGDKKYKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSETELKSNPISKSLVEYELGEYQNARIETIKDMLLLEETLIEKYKTLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 128 - protein, 1133 aa, Prevotella intermedia
MEDDKKTTDSISYELKDKHFWAAFLNLARHNVYITVNHINKVLELKNKKDQDIIIDNDQDILAIKTHWEKVNGDLNKTERLRELMTKHFPFLETAIYSKNKEDKEEVKQEKQAKAQSFDSLKHCLFLFLEKLQETRNYYSHYKYSESTKEPMLEKELLKKMYNIFDDNIQLVIKDYQHNKDINPDEDFKHLDRTEEDFNYYFTRNKKGNITESGLLFFVSLFLEKKDAIWMQQKLRGFKDNRESKKKMTHEVFCRSRMLLPKLRLESTQTQDWILLDMLNELIRCPKSLYERLQGEDREKFKVPFDPADEDYDAEQEPFKNTLVRHQDRFPYFALRYFDYNEIFTNLRFQIDLGTFHFSIYKKLIGGQKEDRHLTHKLYGFERIQEFAKQNRPDEWKAIVKDLDTYETSNERYISETTPHYHLENQKIGIRFRNDNDEIWPSLKTNGENNEKSKYKLDKQYQAEAFLSVHELLPMMFYYLLLKKEEPNNDKKNASIVEGFIKREIRDMYKLYDAFANGEINNIDDLEKYCEDKGIPKRHLPKQMVAILYDEHKDMVKEAKRKQRKMVKDTEKLLAALEKQTQEKTEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSKEYEKVEALDRVGLVTKVIPLFFKKEDSKDKEEDLKKDAQKEINNCVQPFYSFPYNVGNIHKPDEKDFLHREERIELWDKKKDKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSEAELKSNPISKSLVEYELGEYQNARIETIKDMLLLEETLIEKYKNLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 129 - protein, 1127 aa, Prevotella buccae; identical to SEQ ID NO: 51

SEQ ID NO: 130 - protein, 1125 aa, Prevotella pallens
MKEEEKGKTPVVSTYNKDDKHFWAAFLNLARHNVYITVNHINKILGEGEINRDGYENTLEKSWNEIKDINKKDRLSKLIIKHFPFLEVTTYQRNSADTTKQKEEKQAEAQSLESLKKSFFVFIYKLRDLRNHYSHYKHSKSLERPKFEEDLQEKMYNIFDASIQLVKEDYKHNTDIKTEEDFKHLDRKGQFKYSFADNEGNITESGLLFFVSLFLEKKDAIWVQKKLEGFKCSNESYQKMTNEVFCRSRMLLPKLRLQSTQTQDWILLDMLNELIRCPKSLYERLREEDRKKFRVPIEIADEDYDAEQEPFKNALVRHQDRFPYFALRYFDYNEIFTNLRFQIDLGTYHFSIYKKQIGDYKESHHLTHKLYGFERIQEFTKQNRPDEWRKFVKTFNSFETSKEPYIPETTPHYHLENQKIGIRFRNDNDKIWPSLKTNSEKNEKSKYKLDKSFQAEAFLSVHELLPMMFYYLLLKTENTDNDNEIETKKKENKNDKQEKHKIEEIIENKITEIYALYDAFANGKINSIDKLEEYCKGKDIEIGHLPKQMIAILKSEHKDMATEAKRKQEEMLADVQKSLESLDNQINEEIENVERKNSSLKSGEIASWLVNDMMRFQPVQKDNEGNPLNNSKANSTEYQMLQRSLALYNKEEKPTRYFRQVNLIESSNPHPFLNNTEWEKCNNILSFYRSYLEAKKNFLESLKPEDWEKNQYFLMLKEPKTNCETLVQGWKNGFNLPRGIFTEPIRKWFMEHRKNITVAELKRVGLVAKVIPLFFSEEYKDSVQPFYNYLFNVGNINKPDEKNFLNCEERRELLRKKKDEFKKMTDKEKEENPSYLEFQSWNKFERELRLVRNQDIVTWLLCMELFNKKKIKELNVEKIYLKNINTNTTKKEKNTEEKNGEEKIIKEKNNILNRIMPMRLPIKVYGRENFSKNKKKKIRRNTFFTVYIEEKGTKLLKQGNFKALERDRRLGGLFSFVKTHSKAESKSNTISKSRVEYELGEYQKARIEIIKDMLALEETLIDKYNSLDTDNFHNMLTGWLKLKDEPDKASFQNDVDLLIAVRNAFSHNQYPMRNRIAFANINPFSLSSANTSEEKGLGIANQLKDKTHKTIEKIIEIEKPIETKE

SEQ ID NO: 131 - protein, 1157 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSEIVIENKVLDFLNSSLVSTALHVKDKYLKTDKTKEFLKETIAAELDILIEAYKKKQIEKKNTRFKANKREDILNAIYNEAFWSFINDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKANYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMTEEFKSKWKGYQHTELQKLFAYYDTSKSDLDLILSDMVMVKDYPIELIALVKKSRTLVDFLNKYLEARLGYMENVITRVKNSIGTPQFKTVRKECFTFLKKSNYTVVSLDKQVERILSMPLFIERGFMDDKPTMLEGKSYQQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCEGLVRIDKVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLVPIGMDVREMLILSTDVKFIKEEIIQLGQAGEVEQDLYSLIYIRNKFAHNQLPIKEFFDFCENNYRSISDNEYYAEYYMEIFRSIKEKYTS

SEQ ID NO: 132 - protein, 1157 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSEIVIENKVLDFLNSSLVSTALHVKDKYLKTDKTKEFLKETIAAELDILIEAYKKKQIEKKNTRFKANKREDILNAIYNEAFWSFINDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHTELQKLFAYFDTSKSDLELILSDMVMVKDYPIELIDLVRKSRTLVDFLNKYLEARLGYIENVITRVKNSIGTPQFKTVRKECFAFLKESNYTVASLDKQIERILSMPLFIERGFMDSKPTMLEGKSYQQHKEDFADWFVHYKENSNYQNFYDTEVYEIITEDKREQAKVTKKIKQQQKNDVFTLMMVNYMLEEVLKLPSNDRLSLNELYQTKEERIVNKQVAKDTQERNKNYIWNKVVDLQLCEGLVRIDKVKLKDIGNFRKYENDSRVKEFLTYQSDIVWSGYLSNEVDSNKLYVIERQLDNYESIRSKELLKEVQEIECIVYNQVANKESLKQSGNENFKQYVLQGLLPRGTDVREMLILSTDVKFKKEEIMQLGQVREVEQDLYSLIYIRNKFAHNQLPIKEFFDFCENNYRPISDNEYYAEYYMEIFRSIKEKYAS

SEQ ID NO: 133 - protein, 1224 aa, Bergeyella zoohelcum; identical to SEQ ID NO: 58

SEQ ID NO: 134 - protein, 1150 aa, Prevotella saccharolytica
MMEKENVQGSHIYYEPTDKCFWAAFYNLARHNAYLTIAHINSFVNSKKGINNDDKVLDIIDDWSKFDNDLLMGARLNKLILKHFPFLKAPLYQLAKRKTRKQQGKEQQDYEKKGDEDPEVIQEAIANAFKMANVRKTLHAFLKQLEDLRNHFSHYNYNSPAKKMEVKFDDGFCNKLYYVFDAALQMVKDDNRMNPEINMQTDFEHLVRLGRNRKIPNTFKYNFTNSDGTINNNGLLFFVSLFLEKRDAIWMQKKIKGFKGGTENYMRMTNEVFCRNRMVIPKLRLETDYDNHQLMFDMLNELVRCPLSLYKRLKQEDQDKFRVPIEFLDEDNEADNPYQENANSDENPTEETDPLKNTLVRHQHRFPYFVLRYFDLNEVFKQLRFQINLGCYHFSIYDKTIGERTEKRHLTRTLFGFDRLQNFSVKLQPEHWKNMVKHLDTEESSDKPYLSDAMPHYQIENEKIGIHFLKTDTEKKETVWPSLEVEEVSSNRNKYKSEKNLTADAFLSTHELLPMMFYYQLLSSEEKTRAAAGDKVQGVLQSYRKKIFDIYDDFANGTINSMQKLDERLAKDNLLRGNMPQQMLAILEHQEPDMEQKAKEKLDRLITETKKRIGKLEDQFKQKVRIGKRRADLPKVGSIADWLVNDMMRFQPAKRNADNTGVPDSKANSTEYRLLQEALAFYSAYKDRLEPYFRQVNLIGGTNPHPFLHRVDWKKCNHLLSFYHDYLEAKEQYLSHLSPADWQKHQHFLLLKVRKDIQNEKKDWKKSLVAGWKNGFNLPRGLFTESIKTWFSTDADKVQITDTKLFENRVGLIAKLIPLYYDKVYNDKPQPFYQYPFNINDRYKPEDTRKRFTAASSKLWNEKKMLYKNAQPDSSDKIEYPQYLDFLSWKKLERELRMLRNQDMMVWLMCKDLFAQCTVEGVEFADLKLSQLEVDVNVQDNLNVLNNVSSMILPLSVYPSDAQGNVLRNSKPLHTVYVQENNTKLLKQGNFKSLLKDRRLNGLFSFIAAEGEDLQQHPLTKNRLEYELSIYQTMRISVFEQTLQLEKAILTRNKTLCGNNFNNLLNSWSEHRTDKKTLQPDIDFLIAVRNAFSHNQYPMSTNTVMQGIEKFNIQTPKLEEKDGLGIASQLAKKTKDAASRLQNIINGGTN

SEQ ID NO: 135 - protein, 1175 aa, Porphyromonas gingivalis
MTEQNEKPYNGTYYTLEDKHFWAAFFNLARHNAYITLTHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRCGNNDNPFFKHHFVDREEKVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAERVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRDLEAWSHSAARRIEDAFAGIENASRENKKKIEQLLQDLSLWETFESKLKVKADKINIAKLKKEILEAKEHPYLDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDETLFSSIRKYDPSSPDAIEERMGLNIAHRLSEEVKQAKEMVERIIQA

SEQ ID NO: 136 - protein, 1115 aa, Bacteroides pyogenes
MESIKNSQKSTGKTLQKDPPYFGLYLNMALLNVRKVENHIRKWLGDVALLPEKSGFHSLLTTDNLSSAKWTRFYYKSRKFLPFLEMFDSDKKSYENRRETTECLDTIDRQKISSLLKEVYGKLQDIRNAFSHYHIDDQSVKHTALIISSEMHRFIENAYSFALQKTRARFTGVFVETDFLQAEEKGDNKKFFAIGGNEGIKLKDNALIFLICLFLDREEAFKFLSRATGFKSTKEKGFLAVRETFCALCCRQPHERLLSVNPREALLMDMLNELNRCPDILFEMLDEKDQKSFLPLLGEEEQAHILENSLNDELCEAIDDPFEMIASLSKRVRYKNRFPYLMLRYIEEKNLLPFIRFRIDLGCLELASYPKKMGEENNYERSVTDHAMAFGRLTDFHNEDAVLQQITKGITDEVRFSLYAPRYAIYNNKIGFVRTGGSDKISFPTLKKKGGEGHCVAYTLQNTKSFGFISIYDLRKILLLSFLDKDKAKNIVSGLLEQCEKHWKDLSENLFDAIRTELQKEFPVPLIRYTLPRSKGGKLVSSKLADKQEKYESEFERRKEKLTEILSEKDFDLSQIPRRMIDEWLNVLPTSREKKLKGYVETLKLDCRERLRVFEKREKGEHPVPPRIGEMATDLAKDIIRMVIDQGVKQRITSAYYSEIQRCLAQYAGDDNRRHLDSIIRELRLKDTKNGHPFLGKVLRPGLGHTEKLYQRYFEEKKEWLEATFYPAASPKRVPRFVNPPTGKQKELPLIIRNLMKERPEWRDWKQRKNSHPIDLPSQLFENEICRLLKDKIGKEPSGKLKWNEMFKLYWDKEFPNGMQRFYRCKRRVEVFDKVVEYEYSEEGGNYKKYYEALIDEVVRQKISSSKEKSKLQVEDLTLSVRRVFKRAINEKEYQLRLLCEDDRLLFMAVRDLYDWKEAQLDLDKIDNMLGEPVSVSQVIQLEGGQPDAVIKAECKLKDVSKLMRYCYDGRVKGLMPYFANHEATQEQVEMELRHYEDHRRRVFNWVFALEKSVLKNEKLRRFYEESQGGCEHRRCIDALRKASLVSEEEYEFLVHIRNKSAHNQFPDLEIGKLPPNVTSGFCECIWSKYKAIICRIIPFIDPERRFFGKLLEQK

SEQ ID NO: 137 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLQKFRKDGDGKARAIPLVGEMATFLSQDIVRMIISEETKKLITSAYYNEMQRSLAQYAGEENRHQFRAIVAELRLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 138 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 139 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLQKFRKDGDGKARAIPLVGEMATFLSQDIVRMIISEETKKLITSAYYNEMQRSLAQYAGEENRHQFRAIVAELRLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKVMELLKVKDGKKKWNEAFKDWWSTKYPDGMQPFYGLRRELNIHGKSVSYIPSDGKKFADCYTHLMEKTVRDKKRELRTAGKPVPPDLAAYIKRSFHRAVNEREFMLRLVQEDDRLMLMAINKIMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEIPLIYRDVSAKVGSIEGSSAKDLPEGSSLVDSLWKKYEMIIRKILPILDPENRFFGKLLNNMSQPINDL

SEQ ID NO: 140 - protein, 1125 aa, Prevotella intermedia
MKMEDDKKTTESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAEAQSLESLKDCLFLFLEKLQEARNYYSHYKYSESTKEPMLEEGLLEKMYNIFDDNIQLVIKDYQHNKDINPDEDFKHLDRKGQFKYSFADNEGNITESGLLFFVSLFLEKKDAIWMQQKLTGFKDNRESKKKMTHEVFCRRRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRPDEWKALVKDLDTYETSNERYISETTPHYHLENQKIGIRFRNGNKEIWPSLKTNGENNEKSKYKLDKPYQAEAFLSVHELLPMMFYYLLLKKEEPNNDKKNASIVEGFIKREIRDMYKLYDAFANGEINNIGDLEKYCEDKGIPKRHLPKQMVAILYDEPKDMVKEAKRKQKEMVKDTKKLLATLEKQTQEEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRNYLTKKIEFLNKLKPEDWEKNQYFLKLKEPKTNRETLVQGWKNGFNLPRGIFTEPIREWFKRHQNDSKEYEKVEALKRVGLVTKVIPLFFKEEYFKEDAQKEINNCVQPFYSFPYNVGNIHKPDEKDFLPSEERKKLWGDKKDKFKGYKAKVKSKKLTDKEKEEYRSYLEFQSWNKFERELRLVRNQDIVTWLLCTELIDKMKVEGLNVEELQKLRLKDIDTDTAKQEKNNILNRIMPMQLPVTVYEIDDSHNIVKDRPLHTVYIEETKTKLLKQGNFKALVKDRRLNGLFSFVDTSSKAELKDKPISKSVVEYELGEYQNARIETIKDMLLLEKTLIKKYEKLPTDNFSDMLNGWLEGKDESDKARFQNDVKLLVAVRNAFSHNQYPMRNRIAFANINPFSLSSADISEEKKLDIANQLKDKTHKIIKKIIEIEKPIETKE

SEQ ID NO: 141 - protein, 1161 aa, unidentified
  source 1..1161: note = Bacteroidetes bacterium
MENQTQKGKGIYYYYTKNEDKHYFGSFLNLANNNIEQIIEEFRIRLSLKDEKNIKEIINNYFTDKKSYTDWERGINILKEYLPVIDYLDLAITDKEFEKIDLKQKETAKRKYFRTNFSLLIDTIIDLRNFYTHYFHKPISINPDVAKFLDKNLLNVCLDIKKQKMKTDKTKQALKDGLDKELKKLIELKKAELKEKKIKTWNITENVEGAVYNDAFNHMVYKNNAGVTILKDYHKSILPDDKIDSELKLNFSISGLVFLLSMFLSKKEIEQFKSNLEGFKGKVIGENGEYEISKFNNSLKYMATHWIFSYLTFKGLKQRVKNTFDKETLLMQMIDELNKVPHEVYQTLSKEQQNEFLEDINEYVQDNEENKKSMENSIVVHPVIRKRYDDKFNYFAIRFLDEFANFPTLKFFVTAGNFVHDKREKQIQGSMLTSDRMIKEKINVFGKLTEIAKYKSDYFSNENTLETSEWELFPNPSYLLIQNNIPVHIDLIHNTEEAKQCQIAIDRIKCTTNPAKKRNTRKSKEEIIKIIYQKNKNIKYGDPTALLSSNELPALIYELLVNKKSGKELENIIVEKIVNQYKTIAGFEKGQNLSNSLITKKLKKSEPNEDKINAEKIILAINRELEITENKLNIIKNNRAEFRTGAKRKHIFYSKELGQEATWIAYDLKRFMPEASRKEWKGFHHSELQKFLAFYDRNKNDAKALLNMFWNFDNDQLIGNDLNSAFREFHFDKFYEKYLIKRDEILEGFKSFISNFKDEPKLLKKGIKDIYRVFDKRYYIIKSTNAQKEQLLSKPICLPRGIFDNKPTYIEGVKVESNSALFADWYQYTYSDKHEFQSFYDMPRDYKEQFEKFELNNIKSIQNKKNLNKSDKFIYFRYKQDLKIKQIKSQDLFIKLMVDELFNVVFKNNIELNLKKLYQTSDERFKNQLIADVQKNREKGDTSDNKMNENFIWNMTIPLSLCNGQIEEPKVKLKDIGKFRKLETDDKVIQLLEYDKSKVWKKLEIEDELENMPNSYERIRREKLLKGIQEFEHFLLEKEKFDGINHPKHFEQDLNPNFKTYVINGVLRKNSKLNYTEIDKLLDLEHISIKDIETSAKEIHLAYFLIHVRNKFGHNQLPKLEAFELMKKYYKKNNEETYAEYFHKVSSQIVNEFKNSLEKHS

SEQ ID NO: 142 - protein, 1165 aa, Chryseobacterium jejuense
MEKTQTGLGIYYDHTKLQDKYFFGGFFNLAQNNIDNVIKAFIIKFFPERKDKDINIAQFLDICFKDNDADSDFQKKNKFLRIHFPVIGFLTSDNDKAGFKKKFALLLKTISELRNFYTHYYHKSIEFPSELFELLDDIFVKTTSEIKKLKKKDDKTQQLLNKNLSEEYDIRYQQQIERLKELKAQGKRVSLTDETAIRNGVFNAAFNHLIYRDGENVKPSRLYQSSYSEPDPAENGISLSQNSILFLLSMFLERKETEDLKSRVKGFKAKIIKQGEEQISGLKFMATHWVFSYLCFKGIKQKLSTEFHEETLLIQIIDELSKVPDEVYSAFDSKTKEKFLEDINEYMKEGNADLSLEDSKVIHPVIRKRYENKFNYFAIRFLDEYLSSTSLKFQVHVGNYVHDRRVKHINGTGFQTERIVKDRIKVFGRLSNISNLKADYIKEQLELPNDSNGWEIFPNPSYIFIDNNVPIHVLADEATKKGIELFKDKRRKEQPEELQKRKGKISKYNIVSMIYKEAKGKDKLRIDEPLALLSLNEIPALLYQILEKGATPKDIELIIKNKLTERFEKIKNYDPETPAPASQISKRLRNNTTAKGQEALNAEKLSLLIEREIENTETKLSSIEEKRLKAKKEQRRNTPQRSIFSNSDLGRIAAWLADDIKRFMPAEQRKNWKGYQHSQLQQSLAYFEKRPQEAFLLLKEGWDTSDGSSYWNNWVMNSFLENNHFEKFYKNYLMKRVKYFSELAGNIKQHTHNTKFLRKFIKQQMPADLFPKRHYILKDLETEKNKVLSKPLVFSRGLFDNNPTFIKGVKVTENPELFAEWYSYGYKTEHVFQHFYGWERDYNELLDSELQKGNSFAKNSIYYNRESQLDLIKLKQDLKIKKIKIQDLFLKRIAEKLFENVFNYPTTLSLDEFYLTQEERAEKERIALAQSLREEGDNSPNIIKDDFIWSKTIAFRSKQIYEPAIKLKDIGKFNRFVLDDEESKASKLLSYDKNKIWNKEQLERELSIGENSYEVIRREKLFKEIQNLELQILSNWSWDGINHPREFEMEDQKNTRHPNFKMYLVNGILRKNINLYKEDEDFWLESLKENDFKTLPSEVLETKSEMVQLLFLVILIRNQFAHNQLPEIQFYNFIRKNYPEIQNNTVAELYLNLIKLAVQKLKDNS

SEQ ID NO: 143 - protein, 1156 aa, Chryseobacterium carnipullorum
MNTRVTGMGVSYDHTKKEDKHFFGGFLNLAQDNITAVIKAFCIKFDKNPMSSVQFAESCFTDKDSDTDFQNKVRYVRTHLPVIGYLNYGGDRNTFRQKLSTLLKAVDSLRNFYTHYYHSPLALSTELFELLDTVFASVAVEVKQHKMKDDKTRQLLSKSLAEELDIRYKQQLERLKELKEQGKNIDLRDEAGIRNGVLNAAFNHLIYKEGEIAKPTLSYSSFYYGADSAENGITISQSGLLFLLSMFLGKKEIEDLKSRIRGFKAKIVRDGEENISGLKFMATHWIFSYLSFKGMKQRLSTDFHEETLLIQIIDELSKVPDEVYHDFDTATREKFVEDINEYIREGNEDFSLGDSTIIHPVIRKRYENKFNYFAVRFLDEFIKFPSLRFQVHLGNFVHDRRIKDIHGTGFQTERVVKDRIKVFGKLSEISSLKTEYIEKELDLDSDTGWEIFPNPSYVFIDNNIPIYISTNKTFKNGSSEFIKLRRKEKPEEMKMRGEDKKEKRDIASMIGNAGSLNSKTPLAMLSLNEMPALLYEILVKKTTPEEIELIIKEKLDSHFENIKNYDPEKPLPASQISKRLRNNTTDKGKKVINPEKLIHLINKEIDATEAKFALLAKNRKELKEKFRGKPLRQTIFSNMELGREATWLADDIKRFMPDILRKNWKGYQHNQLQQSLAFFNSRPKEAFTILQDGWDFADGSSFWNGWIINSFVKNRSFEYFYEAYFEGRKEYFSSLAENIKQHTSNHRNLRRFIDQQMPKGLFENRHYLLENLETEKNKILSKPLVFPRGLFDTKPTFIKGIKVDEQPELFAEWYQYGYSTEHVFQNFYGWERDYNDLLESELEKDNDFSKNSIHYSRTSQLELIKLKQDLKIKKIKIQDLFLKLIAGHIFENIFKYPASFSLDELYLTQEERLNKEQEALIQSQRKEGDHSDNIIKDNFIGSKTVTYESKQISEPNVKLKDIGKFNRFLLDDKVKTLLSYNEDKVWNKNDLDLELSIGENSYEVIRREKLFKKIQNFELQTLTDWPWNGTDHPEEFGTTDNKGVNHPNFKMYVVNGILRKHTDWFKEGEDNWLENLNETHFKNLSFQELETKSKSIQTAFLIIMIRNQFAHNQLPAVQFFEFIQKKYPEIQGSTTSELYLNFINLAVVELLELLEK

SEQ ID NO: 144 - protein, 1036 aa, Chryseobacterium ureilyticum
METQILGNGISYDHTKTEDKHFFGGFLNTAQNNIDLLIKAYISKFESSPRKLNSVQFPDVCFKKNDSDADFQHKLQFIRKHLPVIQYLKYGGNREVLKEKFRLLLQAVDSLRNFYTHFYHKPIQLPNELLTLLDTIFGEIGNEVRQNKMKDDKTRHLLKKNLSEELDFRYQEQLERLRKLKSEGKKVDLRDTEAIRNGVLNAAFNHLIFKDAEDFKPTVSYSSYYYDSDTAENGISISQSGLLFLLSMFLGRREMEDLKSRVRGFKARIIKHEEQHVSGLKFMATHWVFSEFCFKGIKTRLNADYHEETLLIQLIDELSKVPDELYRSFDVATRERFIEDINEYIRDGKEDKSLIESKIVHPVIRKRYESKFNYFAIRFLDEFVNFPTLRFQVHAGNYVHDRRIKSIEGTGFKTERLVKDRIKVFGKLSTISSLKAEYLAKAVNITDDTGWELLPHPSYVFIDNNIPIHLTVDPSFKNGVKEYQEKRKLQKPEEMKNRQGGDKMHKPAISSKIGKSKDINPESPVALLSMNEIPALLYEILVKKASPEEVEAKIRQKLTAVFERIRDYDPKVPLPASQVSKRLRNNTDTLSYNKEKLVELANKEVEQTERKLALITKNRRECREKVKGKFKRQKVFKNAELGTEATWLANDIKRFMPEEQKKNWKGYQHSQLQQSLAFFESRPGEARSLLQAGWDFSDGSSFWNGWVMNSFARDNTFDGFYESYLNGRMKYFLRLADNIAQQSSTNKLISNFIKQQMPKGLFDRRLYMLEDLATEKNKILSKPLIFPRGIFDDKPTFKKGVQVSEEPEAFADWYSYGYDVKHKFQEFYAWDRDYEELLREELEKDTAFTKNSIHYSRESQIELLAKKQDLKVKKVRIQDLYLKLMAEFLFENVFGHELALPLDQFYLTQEERLKQEQEAIVQSQRPKGDDSPNIVKENFIWSKTIPFKSGRVFEPNVKLKDIGKFRNLLTDEKVDILLSYNNTEIGKQVIENELIIGAGSYEFIRREQLFKEIQQMKRLSLRSVRGMGVPIRLNLK

SEQ ID NO: 145 - protein, 1127 aa, Prevotella buccae
MQKQDKLFVDRKKNAIFAFPKYITIMENQEKPEPIYYELTDKHFWAAFLNLARHNVYTTINHINRRLEIAELKDDGYMMDIKGSWNEQAKKLDKKVRLRDLIMKHFPFLEAAAYEITNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYDAEEEPFKNTLVRHQDRFPYFVLRYFDLNEIFEQLRFQIDLGTYHFSIYNKRIGDEDEVRHLTHHLYGFARIQDFAQQNQPEVWRKLVKDLDYFEASQEPYIPKTAPHYHLENEKIGIKFCSTHNNLFPSLKTEKTCNGRSKFNLGTQFTAEAFLSVHELLPMMFYYLLLTKDYSRKESADKVEGIIRKEISNIYAIYDAFANGEINSIADLTCRLQKTNILQGHLPKQMISILEGRQKDMEKEAERKIGEMIDDTQRRLDLLCKQTNQKIRIGKRNAGLLKSGKIADWLVNDMMRFQPVQKDQNNIPINNSKANSTEYRMLQRALALFGSENFRLKAYFNQMNLVGNDNPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNKLKPQKGQFLDKKERVELWQKNKELFKNYPSEKKKTDLAYLDFLSWKKFERELRLIKNQDIVTWLMFKELFNMATVEGLKIGEIHLRDIDTNTANEESNNILNRIMPMKLPVKTYETDNKGNILKERPLATFYIEETETKVLKQGNFKVLAKDRRLNGLLSFAETTDIDLEKNPITKLSVDHELIKYQTTRISIFEMTLGLEKKLINKYPTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 146 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHNLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 147 - protein, 1175 aa, Porphyromonas gingivalis
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREEKVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRDLEAWSHSAARRIEDAFVGIEYASWENKKKIEQLLQDLSLWETFESKLKVKADKINIAKLKKEILEAKEHPYHDFKSWQKFERELRLVKNQDIITWMMCRDLMEENKVEGLDTGTLYLKDIRTDVQEQGSLNVLNHVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLDKWPDLQREVRLLIAVRNAFSHNQYPMYDETIFSSIRKYDPSSLDAIEERMGLNIAHRLSEEVKLAKEMVERIIQA

SEQ ID NO: 148 - protein, 1125 aa, Prevotella pallens; identical to SEQ ID NO: 130

SEQ ID NO: 149 - protein, 1157 aa, Myroides odoratimimus; identical to SEQ ID NO: 131

SEQ ID NO: 150 - protein, 1157 aa, Myroides odoratimimus; identical to SEQ ID NO: 132

SEQ ID NO: 151 - protein, 1127 aa, Prevotella sp.
MQKQDKLFVDRKKNAIFAFPKYITIMENQEKPEPIYYELTDKHFWAAFLNLARHNVYTTINHINRRLEIAELKDDGYMMGIKGSWNEQAKKLDKKVRLRDLIMKHFPFLEAAAYEITNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYDAEEEPFKNTLVRHQDRFPYFVLRYFDLNEIFEQLRFQIDLGTYHFSIYNKRIGDEDEVRHLTHHLYGFARIQDFAPQNQPEEWRKLVKDLDHFETSQEPYISKTAPHYHLENEKIGIKFCSTHNNLFPSLKREKTCNGRSKFNLGTQFTAEAFLSVHELLPMMFYYLLLTKDYSRKESADKVEGIIRKEISNIYAIYDAFANNEINSIADLTCRLQKTNILQGHLPKQMISILEGRQKDMEKEAERKIGEMIDDTQRRLDLLCKQTNQKIRIGKRNAGLLKSGKIADWLVSDMMRFQPVQKDTNNAPINNSKANSTEYRMLQHALALFGSESSRLKAYFRQMNLVGNANPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNKLKPQKGQFLDKKERVELWQKNKELFKNYPSEKNKTDLAYLDFLSWKKFERELRLIKNQDIVTWLMFKELFKTTTVEGLKIGEIHLRDIDTNTANEESNNILNRIMPMKLPVKTYETDNKGNILKERPLATFYIEETETKVLKQGNFKVLAKDRRLNGLLSFAETTDIDLEKNPITKLSVDYELIKYQTTRISIFEMTLGLEKKLIDKYSTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 152 - protein, 1119 aa, Porphyromonas gingivalis
MTEQNERPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREEKVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSDEASAERVQGRIKRVIEDVYAVYDAFARGEINTRDELDACLADKGIRRGHLPRQMIGILSQEHKDMEEKVRKKLQEMIVDTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMICRDLMEENKVEGLDTGTLYLKDIRTDVQEQGNLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDEAVFSSIRKYDPSSPDAIEERMGLNIAHRLSEEVKQAKEMAERIIQA

SEQ ID NO: 153 - protein, 1154 aa, Paludibacter propionicigenes
MKTSANNIYFNGINSFKKIFDSKGAIAPIAEKSCRNFDIKAQNDVNKEQRIHYFAVGHTFKQLDTENLFEYVLDENLRAKRPTRFISLQQFDKEFIENIKRLISDIRNINSHYIHRFDPLKIDAVPTNIIDFLKESFELAVIQIYLKEKGINYLQFSENPHADQKLVAFLHDKFLPLDEKKTSMLQNETPQLKEYKEYRKYFKTLSKQAAIDQLLFAEKETDYIWNLFDSHPVLTISAGKYLSFYSCLFLLSMFLYKSEANQLISKIKGFKKNTTEEEKSKREIFTFFSKRFNSMDIDSEENQLVKFRDLILYLNHYPVAWNKDLELDSSNPAMTDKLKSKIIELEINRSFPLYEGNERFATFAKYQIWGKKHLGKSIEKEYINASFTDEEITAYTYETDTCPELKDAHKKLADLKAAKGLFGKRKEKNESDIKKTETSIRELQHEPNPIKDKLIQRIEKNLLTVSYGRNQDRFMDFSARFLAEINYFGQDASFKMYHFYATDEQNSELEKYELPKDKKKYDSLKFHQGKLVHFISYKEHLKRYESWDDAFVIENNAIQLKLSFDGVENTVTIQRALLIYLLEDALRNIQNNTAENAGKQLLQEYYSHNKADLSAFKQILTQQDSIEPQQKTEFKKLLPRRLLNNYSPAINHLQTPHSSLPLILEKALLAEKRYCSLVVKAKAEGNYDDFIKRNKGKQFKLQFIRKAWNLMYFRNSYLQNVQAAGHHKSFHIERDEFNDFSRYMFAFEELSQYKYYLNEMFEKKGFFENNEFKILFQSGTSLENLYEKTKQKFEIWLASNTAKTNKPDNYHLNNYEQQFSNQLFFINLSHFINYLKSTGKLQTDANGQIIYEALNNVQYLIPEYYYTDKPERSESKSGNKLYNKLKATKLEDALLYEMAMCYLKADKQIADKAKHPITKLLTSDVEFNITNKEGIQLYHLLVPFKKIDAFIGLKMHKEQQDKKHPTSFLANIVNYLELVKNDKDIRKTYEAFSTNPVKRTLTYDDLAKIDGHLISKSIKFTNVTLELERYFIFKESLIVKKGNNIDFKYIKGLRNYYNNEKKKNEGIRNKAFHFGIPDSKSYDQLIRDAEVMFIANEVKPTHATKYTDLNKQLHTVCDKLMETVHNDYFSKEGDGKKKREAAGQKYFENIISAK

SEQ ID NO: 154 - protein, 1119 aa, Porphyromonas gingivalis
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKNKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREGTVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEEDTDGAEEDPFKNTLVRHQDRFPYFALRYFDLKKVFTSLRFQIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRFTAEAFLSAHELMPMMFYYFLLREKYSEEASAERVQGRIKRVIEDVYAVYDAFARDEINTRDELDACLADKGIRRGHLPRQMIGILSQEHKDMEEKIRKKLQEMMADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDWVQPFYNYPFNVGNSLKPKKGRFLSKEKRAEEWESGKERFRLAKLKKEILEAKEHPYLDFKSWQKFERELRLVKNQDIITWMICGDLMEENKVEGLDTGTLYLKDIRTDVQEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRCPHLPDKNFRKMLESWSDPLLDKWPDLHRKVRLLIAVRNAFSHNQYPMYDEAVFSSIRKYDPSFPDAIEERMGLNIAHRLSEEVKQAKETVERIIQA

SEQ ID NO: 155 - protein, 1179 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLRPFLEENKTDDKQNKTVSLRKYRKSKPNEETSITLTQSGLVFLMSFFLHRKEFQVFTSGLEGFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLSLVTEYKKNVYLKETSNIDLSRFPLFPNPSYVMANNNIPFYIDSRSNNLDEYLNQKKKAQSQNKKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLIKTINTDSSVTFENQPIDIPRLKNAIQKELTLTQEKLLNVKEHEIEVDNYNRNKNTYKFKNQPKNKVDDKKLQRKYVFYRNEIRQEANWLASDLIHFMKNKSLWKGYMHNELQSFLAFFEDKKNDCIALLETVFNLKEDCILTKGLKNLFLKHGNFIDFYKEYLKLKEDFLNTESTFLENGLIGLPPKILKKELSKRFKYIFIVFQKRQFIIKELEEKKNNLYADAINLSRGIFDEKPTMIPFKKPNPDEFASWFVASYQYNNYQSFYELTPDIVERDKKKKYKNLRAINKVKIQDYYLKLMVDTLYQDLFNQPLDKSLSDFYVSKAEREKIKADAKAYQKRNDSSLWNKVIHLSLQNNRITANPKLKDIGKYKRALQDEKIATLLTYDDRTWTYALQKPEKENENDYKELHYTALNMELQEYEKVRSKELLKQVQELEKQILEEYTDFLSTQIHPADFEREGNPNFKKYLAHSILENEDDLDKLPEKVEAMRELDETITNPIIKKAIVLIIIRNKMAHNQYPPKFIYDLANRFVPKKEEEYFATYFNRVFETITKELWENKEKKDKTQV

SEQ ID NO: 156 - protein, 1145 aa, Psychroflexus torquis
MESIIGLGLSFNPYKTADKHYFGSFLNLVENNLNAVFAEFKERISYKAKDENISSLIEKHFIDNMSIVDYEKKISILNGYLPIIDFLDDELENNLNTRVKNFKKNFIILAEAIEKLRDYYTHFYHDPITFEDNKEPLLELLDEVLLKTILDVKKKYLKTDKTKEILKDSLREEMDLLVIRKTDELREKKKTNPKIQHTDSSQIKNSIFNDAFQGLLYEDKGNNKKTQVSHRAKTRLNPKDIHKQEERDFEIPLSTSGLVFLMSLFLSKKEIEDFKSNIKGFKGKVVKDENHNSLKYMATHRVYSILAFKGLKYRIKTDTFSKETLMMQMIDELSKVPDCVYQNLSETKQKDFIEDWNEYFKDNEENTENLENSRVVHPVIRKRYEDKFNYFAIRFLDEFANFKTLKFQVFMGYYIHDQRTKTIGTTNITTERTVKEKINVFGKLSKMDNLKKHFFSQLSDDENTDWEFFPNPSYNFLTQADNSPANNIPIYLELKNQQIIKEKDAIKAEVNQTQNRNPNKPSKRDLLNKILKTYEDFHQGDPTAILSLNEIPALLHLFLVKPNNKTGQQIENIIRIKIEKQFKAINHPSKNNKGIPKSLFADTNVRVNAIKLKKDLEAELDMLNKKHIAFKENQKASSNYDKLLKEHQFTPKNKRPELRKYVFYKSEKGEEATWLANDIKRFMPKDFKTKWKGCQHSELQRKLAFYDRHTKQDIKELLSGCEFDHSLLDINAYFQKDNFEDFFSKYLENRIETLEGVLKKLHDFKNEPTPLKGVFKNCFKFLKRQNYVTESPEIIKKRILAKPTFLPRGVFDERPTMKKGKNPLKDKNEFAEWFVEYLENKDYQKFYNAEEYRMRDADFKKNAVIKKQKLKDFYTLQMVNYLLKEVFGKDEMNLQLSELFQTRQERLKLQGIAKKQMNKETGDSSENTRNQTYIWNKDVPVSFFNGKVTIDKVKLKNIGKYKRYERDERVKTFIGYEVDEKWMMYLPHNWKDRYSVKPINVIDLQIQEYEEIRSHELLKEIQNLEQYIYDHTTDKNILLQDGNPNFKMYVLNGLLIGIKQVNIPDFIVLKQNTNFDKIDFTGIASCSELEKKTIILIAIRNKFAHNQLPNKMIYDLANEFLKIEKNETYANYYLKVLKKMISDLA

SEQ ID NO: 157 - protein, 948 aa, Riemerella anatipestifer
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKHQPWEPYQYCLLLKVPKENRKNLVKGWEQGGISLPRGLFTEAIRETLSKDLTLSKPIRKEIKKHGRVGFISRAITLYFKEKYQDKHQSFYNLSYKLEAKAPLLKKEEHYEYWQQNKPQSPTESQRLELHTSDRWKDYLLYKRWQHLEKKLRLYRNQDIMLWLMTLELTKNHFKELNLNYHQLKLENLAVNVQEADAKLNPLNQTLPMVLPVKVYPTTAFGEVQYHETPIRTVYIREEQTKALKMGNFKALVKDRRLNGLFSFIKEENDTQKHPISQLRLRRELEIYQSLRVDAFKETLSLEEKLLNKHASLSSLENEFRTLLEEWKKKYAASSMVTDKHIAFIASVRNAFCHNQYPFYKETLHAPILLFTVAQPTTEEKDGLGIAEALLKVLREYCEIVKSQI

SEQ ID NO: 158 - protein, 1139 aa, Prevotella pleuritidis
MENDKRLEESACYTLNDKHFWAAFLNLARHNVYITVNHINKTLELKNKKNQEIIIDNDQDILAIKTHWAKVNGDLNKTDRLRELMIKHFPFLEAAIYSNNKEDKEEVKEEKQAKAQSFKSLKDCLFLFLEKLQEARNYYSHYKYSESSKEPEFEEGLLEKMYNTFDASIRLVKEDYQYNKDIDPEKDFKHLERKEDFNYLFTDKDNKGKITKNGLLFFVSLFLEKKDAIWMQQKFRGFKDNRGNKEKMTHEVFCRSRMLLPKIRLESTQTQDWILLDMLNELIRCPKSLYERLQGAYREKFKVPFDSIDEDYDAEQEPFRNTLVRHQDRFPYFALRYFDYNEIFKNLRFQIDLGTYHFSIYKKLIGGKKEDRHLTHKLYGFERIQEFTKQNRPDKWQAIIKDLDTYETSNERYISETTPHYHLENQKIGIRFRNDNNDIWPSLKTNGEKNEKSKYNLDKPYQAEAFLSVHELLPMMFYYLLLKMENTDNDKEDNEVGTKKKGNKNNKQEKHKIEEIIENKIKDIYALYDAFTNGEINSIDELAEQREGKDIEIGHLPKQLIVILKNKSKDMAEKANRKQKEMIKDTKKRLATLDKQVKGEIEDGGRNIRLLKSGEIARWLVNDMMRFQPVQKDNEGKPLNNSKANSTEYQMLQRSLALYNKEEKPTRYFRQVNLIKSSNPHPFLEDTKWEECYNILSFYRNYLKAKIKFLNKLKPEDWKKNQYFLMLKEPKTNRKTLVQGWKNGFNLPRGIFTEPIKEWFKRHQNDSEEYKKVEALDRVGLVAKVIPLFFKEEYFKEDAQKEINNCVQPFYSFPYNVGNIHKPEEKNFLHCEERRKLWDKKKDKFKGYKAKEKSKKMTDKEKEEHRSYLEFQSWNKFERELRLVRNQDILTWLLCTKLIDKLKIDELNIEELQKLRLKDIDTDTAKKEKNNILNRVMPMRLPVTVYEIDKSFNIVKDKPLHTVYIEETGTKLLKQGNFKALVKDRRLNGLFSFVKTSSEAESKSKPISKLRVEYELGAYQKARIDIIKDMLALEKTLIDNDENLPTNKFSDMLKSWLKGKGEANKARLQNDVGLLVAVRNAFSHNQYPMYNSEVFKGMKLLSLSSDIPEKEGLGIAKQLKDKIKETIERIIEIEKEIRN

SEQ ID NO: 159 - protein, 1135 aa, Porphyromonas gingivalis; identical to SEQ ID NO: 137

SEQ ID NO: 160 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTNENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 161 - protein, 1135 aa, Porphyromonas gingivalis; identical to SEQ ID NO: 138

SEQ ID NO: 162 - protein, 1135 aa, Porphyromonas gingivalis; identical to SEQ ID NO: 139

SEQ ID NO: 163 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 164 - protein, 1133 aa, Prevotella falsenii
MKNDNNSTKSTDYTLGDKHFWAAFLNLARHNVYITVNHINKVLELKNKKDQEIIIDNDQDILAIKTLWGKVDTDINKKDRLRELIMKHFPFLEAATYQQSSTNNTKQKEEEQAKAQSFESLKDCLFLFLEKLREARNYYSHYKHSKSLEEPKLEEKLLENMYNIFDTNVQLVIKDYEHNKDINPEEDFKHLGRAEGEFNYYFTRNKKGNITESGLLFFVSLFLEKKDAIWAQTKIKGFKDNRENKQKMTHEVFCRSRMLLPKLRLESTQTQDWILLDMLNELIRCPKSLYKRLQGEKREKFRVPFDPADEDYDAEQEPFKNTLVRHQDRFPYFALRYFDYNEIFTNLRFQIDLGTYHFSIYKKQIGDKKEDRHLTHKLYGFERIQEFAKENRPDEWKALVKDLDTFEESNEPYISETTPHYHLENQKIGIRNKNKKKKKTIWPSLETKTTVNERSKYNLGKSFKAEAFLSVHELLPMMFYYLLLNKEEPNNGKINASKVEGIIEKKIRDIYKLYGAFANEEINNEEELKEYCEGKDIAIRHLPKQMIAILKNEYKDMAKKAEDKQKKMIKDTKKRLAALDKQVKGEVEDGGRNIKPLKSGRIASWLVNDMMRFQPVQRDRDGYPLNNSKANSTEYQLLQRTLALFGSERERLAPYFRQMNLIGKDNPHPFLKDTKWKEHNNILSFYRSYLEAKKNFLGSLKPEDWKKNQYFLKLKEPKTNRETLVQGWKNGFNLPRGIFTEPIREWFIRHQNESEEYKKVKDFDRIGLVAKVIPLFFKEDYQKEIEDYVQPFYGYPFNVGNIHNSQEGTFLNKKEREELWKGNKTKFKDYKTKEKNKEKTNKDKFKKKTDEEKEEFRSYLDFQSWKKFERELRLVRNQDIVTWLLCMELIDKLKIDELNIEELQKLRLKDIDTDTAKKEKNNILNRIMPMELPVTVYETDDSNNIIKDKPLHTIYIKEAETKLLKQGNFKALVKDRRLNGLFSFVETSSEAELKSKPISKSLVEYELGEYQRARVEIIKDMLRLEETLIGNDEKLPTNKFRQMLDKWLEHKKETDDTDLKNDVKLLTEVRNAFSHNQYPMRDRIAFANIKPFSLSSANTSNEEGLGIAKKLKDKTKETIDRIIEIEEQTATKR

SEQ ID NO: 165 - protein, 1116 aa, Prevotella pleuritidis
MENDKRLEESTCYTLNDKHFWAAFLNLARHNVYITINHINKLLEIRQIDNDEKVLDIKALWQKVDKDINQKARLRELMIKHFPFLEAAIYSNNKEDKEEVKEEKQAKAQSFKSLKDCLFLFLEKLQEARNYYSHYKSSESSKEPEFEEGLLEKMYNTFGVSIRLVKEDYQYNKDIDPEKDFKHLERKEDFNYLFTDKDNKGKITKNGLLFFVSLFLEKKDAIWMQQKLRGFKDNRGNKEKMTHEVFCRSRMLLPKIRLESTQTQDWILLDMLNELIRCPKSLYERLQGAYREKFKVPFDSIDEDYDAEQEPFRNTLVRHQDRFPYFALRYFDYNEIFKNLRFQIDLGTYHFSIYKKLIGDNKEDRHLTHKLYGFERIQEFAKQKRPNEWQALVKDLDIYETSNEQYISETTPHYHLENQKIGIRFKNKKDKIWPSLETNGKENEKSKYNLDKSFQAEAFLSIHELLPMMFYDLLLKKEEPNNDEKNASIVEGFIKKEIKRMYAIYDAFANEEINSKEGLEEYCKNKGFQERHLPKQMIAILTNKSKNMAEKAKRKQKEMIKDTKKRLATLDKQVKGEIEDGGRNIRLLKSGEIARWLVNDMMRFQSVQKDKEGKPLNNSKANSTEYQMLQRSLALYNKEQKPTPYFIQVNLIKSSNPHPFLEETKWEECNNILSFYRSYLEAKKNFLESLKPEDWKKNQYFLMLKEPKTNRKTLVQGWKNGFNLPRGIFTEPIKEWFKRHQNDSEEYKKVEALDRVGLVAKVIPLFFKEEYFKEDAQKEINNCVQPFYSFPYNVGNIHKPEEKNFLHCEERRKLWDKKKDKFKGYKAKEKSKKMTDKEKEEHRSYLEFQSWNKFERELRLVRNQDIVTWLLCTELIDKLKIDELNIEELQKLRLKDIDTDTAKKEKNNILNRIMPMQLPVTVYEIDKSFNIVKDKPLHTIYIEETGTKLLKQGNFKALVKDRRLNGLFSFVKTSSEAESKSKPISKLRVEYELGAYQKARIDIIKDMLALEKTLIDNDENLPTNKFSDMLKSWLKGKGEANKARLQNDVDLLVAIRNAFSHNQYPMYNSEVFKGMKLLSLSSDIPEKEGLGIAKQLKDKIKETIERIIEIEKEIRN

SEQ ID NO: 166 - protein, 1119 aa, Porphyromonas gingivalis
MTEQNERPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREGTVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPIDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHRKVRLLIAVRNAFSHNQYPMYDEAVFSSIRKYDPSSPDAIEERMGLNIAHRLSEEVKQAKEMAERIIQV

SEQ ID NO: 167 - protein, 1175 aa, Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRMDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKNMEEKVRKKLQEMIADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHDTRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRTNVQEQGSLNVLNHVKPMRLPVVVYRADSRGHVHKEEAPLATVYIEERDTKLLKQGNFKSFVKDRRLNGLFSFVDTGGLAMEQYPISKLRVEYELAKYQTARVCAFEQTLELEESLLTRYPHLPDKNFRKMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 168 - protein, 1119 aa, Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHRHFNHLVRKGKKDRYGHNDNPSFKHHFVDGEGMVTEAGLLFFVSLFLEKRDAIWMQKKIRGFKGGTETYQQMTNEVFCRSRISLPKLKLESLRTDDWMLLDMLNELVRCPKPLYDRLREKDRARFRVPVDILPDEDDTDGGGEDPFKNTLVRHQDRFPYFALRYFDLKKVFTSLRFHIDLGTYHFAIYKKVIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTRDELDACLADKGIRRGHLPKQMIGILSQEHKNMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLDETRWESHTNILSFYRSYLRARKAFLERIGRSDRVENRPFLLLKEPKTDRQTLVAGWKSEFHLPRGIFTEAVRDCLIEMGYDEVGSYKEVGFMAKAVPLYFERACKDRVQPFYDSPFNVGNSLKPKKGRFLSKEKRAEEWESGKERFRLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 169 - protein, 1119 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHYHFNHLVRKGKKDRYGHNDNPSFKHHFVDSEGMVTEAGLLFFVSLFLEKRDAIWMQKKIRGFKGGTGPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFMPEGQHLWPSPEVGTTRTGRSKYAQDKRLTAEAFLSVHELMPMMFYYFLLREKYSEEVSAEKVQGRIKRVIKDVYAIYDAFARDEINTLKELDACSADKGIRRGHLPKQMIGILSQEHKNMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLDETRWESHTNILSFYRSYLRARKAFLERIGRSDRVENRPFLLLKEPKNDRQTLVAGWKSEFHLPRGIFTEAVRDCLIEMGYDEVGSYKEVGFMAKAVPLYFERACKDRVQPFYDSPFNVGNSLKPKKGRFLSKEKRAEEWESGKERFRLAKLKKEILEAKEHPYHDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGGLAMEQYPISKLRVEYELAKYQTARVCAFEQTLELEESLLTRYPHLPDENFREMLESWSDPLLGKWPDLHGKVRLLIAVRNAFSHNQYPMYDEAVFSSIRKYDPSSPDAIEERMGLNIAHRLSEEVKQAKETVERIIQA

SEQ ID NO: 170 - protein, 1175 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDGEGMVTEAGLLFFVSLFLEKRDAIWMQKKIRGFKGGTETYQQMTNEVFCRSRISLPKLKLESLRTDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKDMEEKIRKKLQEMIADTDHRLDMLDRQTDRKIRIGRKNAGLPKSGVIADWLVRDMMRFQPVAKDTSGKPLNNSKANSTEYRMLQRALALFGGEKKRLTPYFRQMNLTGGNNPHPFLHETRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFRKMLESWSDPLLAKWPELHGKVRLLIAVRNAFSHNQYPMYDEAVFSSIRKYDPSSPDAIEERMGLNIAHRLSEEVKQAKETVERIIQV

SEQ ID NO: 171 - protein, 1119 aa, Porphyromonas gulae
MTEQSERPYNGTYYTLEDKHFWAAFLNLARHNAYITLTHIDRQLAYSKADITNDEDILFFKGQWKNLDNDLERKSRLRSLILKHFSFLEGAAYGKKFFESKSSGNKSSKNKELTKKEKEELQANALSLDNLKSILFDFLQKLKDFRNYYSHYRHSGSSELPLFDGNMLQRLYNVFDVSVQRVKRDHEHNDEVDPHYHFNHLVRKGKKDRYGHNDNPSFKHHFVDGEGMVTEAGLLFFVSLFLEKRDAIWMQKKIRGFKGGTEPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIGILSQERKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKGEFHLPRGIFTEAVRDCLIEMGYDEVGSYREVGFMAKAVPLYFERACEDRVQPFYDSPFNVGNSLKPKKGRFLSKEKRAEEWESGKERFRLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLTKWPELHGKVRLLIAVRNAFSHNQYPMYDEAVFSSIWKYDPSSPDAIEERMGLNIAHRLSEEVKQAKETIERIIQA

SEQ ID NO: 172 - protein, 1174 aa, Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHYHFNHLVRKGKKDRYGHNDNPSFKHHFVDSEGMVTEAGLLFFVSLFLEKRDAIWMQKKIRGFKGGTGPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYLETGDKPYISQTTPHYHIEKGKIGLRFVPEGQHLWPSPEVGTTRTGRSKCAQDKRLTAEAFLSVHELMPMMFYYFLLREKYSEEVSAEKVQGRIKRVIEDVYAIYDAFARDEINTLKELDTCLADKGIRRGHLPKQMITILSQERKDMKEKIRKKLQEMIADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKDEFHLPRGIFTEAVRDCLIEMGYDEVGSYREVGFMAKAVPLYFERACEDRVQPFYDSPFNVGNSLKPKKGRFLSKEDRAEEWERGMERFRDLEAWSHSAARRIKDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEAPLATVYIEERNTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 173 - protein, 1135 aa, Porphyromonas gulae
MNTVPATENKGQSRTVEDDPQYFGLYLNLARENLIEVESHVRIKFGKKKLNEESLKQSLLCDHLLSIDRWTKVYGHSRRYLPFLHCFDPDSGIEKDHDSKTGVDPDSAQRLIRELYSLLDFLRNDFSHNRLDGTTFEHLKVSPDISSFITGAYTFACERAQSRFADFFKPDDFLLAKNRKEQLISVADGKECLTVSGFAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVRDKKRELRTAGKPVPPDLAAYIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 174 - protein, 1218 aa, Capnocytophaga cynodegmi
MENKTSLGNNIYYNPFKPQDKSYFAGYLNAAMENIDSVFRELGKRLKGKEYTSENFFDAIFKENISLVEYERYVKLLSDYFPMARLLDKKEVPIKERKENFKKNFRGIIKAVRDLRNFYTHKEHGEVEITDEIFGVLDEMLKSTVLTVKKKKIKTDKTKEILKKSIEKQLDILCQKKLEYLKDTARKIEEKRRNQRERGEKKLVPRFEYSDRRDDLIAAIYNDAFDVYIDKKKDSLKESSKTKYNTESYPQQEEGDLKIPISKNGVVFLLSLFLSKQEVHAFKSKIAGFKATVIDEATVSHRKNSICFMATHEIFSHLAYKKLKRKVRTAEINYSEAENAEQLSIYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKEHLISDRRIKEKITVFGRLSELEHKKALFIKNTETNEDRKHYWEVFPNPNYDFPKENISVNDKDFPIAGSILDREKQPTAGKIGIKVNLLNQKYISEVDKAVKAHQLKQRNNKPSIQNIIEEIVPINGSNPKEIIVFGGQPTAYLSMNDIHSILYEFFDKWEKKKEKLEKKGEKELRKEIGKELEEKIVGKIQTQIQQIIDKDINAKILKPYQDDDSTAIDKEKLIKDLKQEQKILQKLKNEQTAREKEYQECIAYQEESRKIKRSDKSRQKYLRNQLKRKYPEVPTRKEILYYQEKGKVAVWLANDIKRFMPTDFKNEWKGEQHSLLQKSLAYYEQCKEELKNLLPQQKVFKHLPFELGGHFQQKYLYQFYTRYLDKRLEHISGLVQQAENFKNENKVFKKVENECFKFLKKQNYTHKGLDAQAQSVLGYPIFLERGFMDEKPTIIKGKTFKGNESLFTDWFRYYKEYQNFQTFYDTENYPLVELEKKQADRKRETKIYQQKKNDVFTLLMAKHIFKSVFKQDSIDRFSLEDLYQSREERLENQEKAKQTGERNTNYIWNKTVDLNLCDGKVTVENVKLKNVGNFIKYEYDQRVQTFLKYEENIKWQAFLIKESKEEENYPYIVEREIEQYEKVRREELLKEVHLIEEYILEKVKDKEILKKGDNQNFKYYILNGLLKQLKNEDVESYKVFNLNTKPEDVNINQLKQEATDLEQKAFVLTYIRNKFAHNQLPKKEFWDYCQEKYGKIEKEKTYAEYFAEVFKREKEALMK

SEQ ID NO: 175 - protein, 1090 aa, unidentified
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLIDGCEFLTSTEQPLSGMISKYYTVALRNTKERYGYKTEDLAFIQDNIKKITKDAYGKRKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSTDRFVPLLLQYIDYGKLFDHIRFHVNMGKLRYLLKADKTCIDGQTRVRVIEQPLNGFGRLEEAETMRKQENGTFGNSGIRIRDFENVKRDDANPANYPYIVDTYTHYILENNKVEMFISDKGSSAPLLPLIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVDFYERYLIERKFYLTGLCNEIKRGNRVDVPFIRRDQNKWKTPAMKTLGRIYSEDLPVELPRQMFDNEIKSHLKSLPQMEGIDFNNANVTYLIAEYMKRVLNDDFQTFYQWKRNYHYMDMLKGEYDRKGSLQHCFTSVEEREGLWKERASRTERYRKLASNKIRSNRQMRNASSEEIETILDKRLSNCRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGIVEIKALPEIAMSIKKAFGEYAIMK

SEQ ID NO: 176 - protein, 1090 aa, unidentified
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDQASHYKTYDEKLIDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKQPKDRIHSEKSNKSVAMDMLNEIKRCPNELFETLSAEKQSRFRIISNDHNEVLMKRSSDRFVPLLLQYIDYGKLFDHIRFHVNMGKLRYLLKADKTCIDGQTRVRVIEQPLNGFGRLEEVETMRKQENGTFGNSGIRIRDFENMKRDDANPANYPYIVDTYTHYILENNKVEMFISDEETPAPLLPVIEDDRYVVKTIPSCRMSTLEIPAMAFHMFLFGSKKTEKLIVDVHNRYKRLFKAMQKEEVTAENIASFGIAESDLPQKIIDLISGNAHGKDVDAFIRLTVDDMLADTERRIKRFKDDRKSIRSADNKMGKRGFKQISTGKLADFLAKDIVLFQPSVNDGENKITGLNYRIMQSAIAVYNSGDDYEAKQQFKLMFEKARLIGKGTTEPHPFLYKVFVRSIPANAVDFYERYLIERKFYLIGLSNEIKKGNRVDVPFIRRDQNKWKTPAMKTLGRIYDEDLPVELPRQMFDNEIKSHLKSLPQMEGIDFNNANVTYLIAEYMKRVLNDDFQTFYQWKRNYRYMDMLRGEYDRKGSLQSCFTSVEEREGLWKERASRTERYRKLASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDTVSKEDIMEEFKKYDQCRPEISSIVFNLEKWAFDTYPELSARVDREEKVDFKSILKILLNNKNINKEQSDILRKIRNAFDHNNYPDKGVVEIRALPEIAMSIKKAFGEYAIMK

SEQ ID NO: 177 - protein, 1090 aa, unidentified
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLIDGCEFLTSTEQPFSGMISKYYTVALRNTKERYGYKAEDLAFIQDNRYKFTKDAYGKRKSQVNTGSFLSLQDYNGDTTKKLHLSGVGIALLICLFLDKQYINLFLSRLPIFSSYNAQSEERRIIIRSFGINSIKQPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEVETMRKQENGTFGNSGIRIRDFENMKRDDANPANYPYIVETYTHYILENNKVEMFISDEENPTPLLPVIEDDRYVVKTIPSCRMSTLEIPAMAFHMFLFGSEKTEKLIIDVHDRYKRLFQAMQKEEVTAENIASFGIAESDLPQKIMDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFVRSIPANAVDFYERYLIERKFYLIGLSNEIKKGNRVDVPFIRRDQNKWKTPAMKTLGRIYSEDLPVELPRQMFDNEIKSHLKSLPQMEGIDFNNANVTYLIAEYMKRVLNDDFQTFYQWKRNYRYMDMLRGEYDRKGSLQHCFTSIEEREGLWKERASRTERYRKLASNKIRSNRQMRNASSEEIETILDKRLSNCRNEYQKSEKIIRRYRVQDALLFLLAKKTLTELADFDGERFKLKEIMPDAEKGILSEIMPMSFTFEKGGKIYTITSGGMKLKNYGDFFVLASDKRIGNLLELVGSNTVSKEDIMEEFKKYDQCRPEISSIVFNLEKWAFDTYPELPARVDRKEKVDFWSILDVLSNNKDINNEQSYILRKIRNAFDHNNYPDKGIVEIKALPEIAMSIKKAFGEYAIMK

SEQ ID NO: 178 - protein, 1131 aa, Phaeodactylibacter xiamenensis
MTNTPKRRTLHRHPSYFGAFLNIARHNAFMIMEHLSTKYDMEDKNTLDEAQLPNAKLFGCLKKRYGKPDVTEGVSRDLRRYFPFLNYPLFLHLEKQQNAEQAATYDINPEDIEFTLKGFFRLLNQMRNNYSHYISNTDYGKFDKLPVQDIYEAAIFRLLDRGKHTKRFDVFESKHTRHLESNNSEYRPRSLANSPDHENTVAFVTCLFLERKYAFPFLSRLDCFRSTNDAAEGDPLIRKASHECYTMFCCRLPQPKLESSDILLDMVNELGRCPSALYNLLSEEDQARFHIKREEITGFEEDPDEELEQEIVLKRHSDRFPYFALRYFDDTEAFQTLRFDVYLGRWRTKPVYKKRIYGQERDRVLTQSIRTFTRLSRLLPIYENVKHDAVRQNEEDGKLVNPDVTSQFHKSWIQIESDDRAFLSDRIEHFSPHYNFGDQVIGLKFINPDRYAAIQNVFPKLPGEEKKDKDAKLVNETADAIISTHEIRSLFLYHYLSKKPISAGDERRFIQVDTETFIKQYIDTIKLFFEDIKSGELQPIADPPNYQKNEPLPYVRGDKEKTQEERAQYRERQKEIKERRKELNTLLQNRYGLSIQYIPSRLREYLLGYKKVPYEKLALQKLRAQRKEVKKRIKDIEKMRTPRVGEQATWLAEDIVFLTPPKMHTPERKTTKHPQKLNNDQFRIMQSSLAYFSVNKKAIKKFFQKETGIGLSNRETSHPFLYRIDVGRCRGILDFYTGYLKYKMDWLDDAIKKVDNRKHGKKEAKKYEKYLPSSIQHKTPLELDYTRLPVYLPRGLFKKAIVKALAAHADFQVEPEEDNVIFCLDQLLDGDTQDFYNWQRYYRSALTEKETDNQLVLAHPYAEQILGTIKTLEGKQKNNKLGNKAKQKIKDELIDLKRAKRRLLDREQYLRAVQAEDRALWLMIQERQKQKAEHEEIAFDQLDLKNITKILTESIDARLRIPDTKVDITDKLPLRRYGDLRRVAKDRRLVNLASYYHVAGLSEIPYDLVKKELEEYDRRRVAFFEHVYQFEKEVYDRYAAELRNENPKGESTYFSHWEYVAVAVKHSADTHFNELFKEKVMQLRNKFHHNEFPYFDWLLPEVEKASAALYADRVFDVAEGYYQKMRKLMRQ

SEQ ID NO: 179 - protein, 1155 aa, unidentified
MDNNITVEKTELGLGITYNHDKVEDKHYFGGFFNLAQNNIDLVAQEFKKRLLIQGKDSINIFANYFSDQCSITNLERGIKILAEYFPVVSYIDLDEKNKSKSIREHLILLLETINNLRNYYTHYYHKKIIIDGSLFPLLDTILLKVVLEIKKKKLKEDKTKQLLKKGLEKEMTILFNLMKAEQKEKKIKGWNIDENIKGAVLNRAFSHLLYNDELSDYRKSKYNTEDETLKDTLTESGILFLLSFFLNKKEQEQLKANIKGYKGKIASIPDEEITLKNNSLRNMATHWTYSHLTYKGLKHRIKTDHEKETLLVNMVDYLSKVPHEIYQNLSEQNKSLFLEDINEYMRDNEENHDSSEASRVIHPVIRKRYENKFAYFAIRFLDEFAEFPTLRFMVNVGNYIHDNRKKDIGGTSLITNRTIKQQINVFGNLTEIHKKKNDYFEKEENKEKTLEWELFPNPSYHFQKENIPIFIDLEKSKETNDLAKEYAKEKKKIFGSSRKKQQNTAKKNRETIINLVFDKYKTSDRKTVTFEQPTALLSFNELNSFLYAFLVENKTGKELEKIIIEKIANQYQILKNCSSTVDKTNDNIPKSIKKIVNTTTDSFYFEGKKIDIEKLEKDITIEIEKTNEKLETIKENEESAQNYKRNERNTQKRKLYRKYVFFTNEIGIEATWITNDILRFLDNKENWKGYQHSELQKFISQYDNYKKEALGLLESEWNLESDAFFGQNLKRMFQSNSTFETFYKKYLDNRKNTLETYLSAIENLKTMTDVRPKVLKKKWTELFRFFDKKIYLLSTIETKINELITKPINLSRGIFEEKPTFINGKNPNKENNQHLFANWFIYAKKQTILQDFYNLPLEQPKAITNLKKHKYKLERSINNLKIEDIYIKQMVDFLYQKLFEQSFIGSLQDLYTSKEKREIEKGKAKNEQTPDESFIWKKQVEINTHNGRIIAKTKIKDIGKFKNLLTDNKIAHLISYDDRIWDFSLNNDGDITKKLYSINTELESYETIRREKLLKQIQQFEQFLLEQETEYSAERKHPEKFEKDCNPNFKKYIIEGVLNKIIPNHEIEEIEILKSKEDVFKINFSDILILNNDNIKKGYLLIMIRNKFAHNQLIDKNLFNFSLQLYSKNENENFSEYLNKVCQNIIQEFKEKLK

SEQ ID NO: 180 - protein, 1175 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRTDDWMLLDMLNELVRCPKPLYDRLREKDRARFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKDMEEKIRKKLQEMIADTDHRLDMLDRQTDRKIRIGRKNAGLPKSGVIADWLVRDMMRFQPVAKDTSGKPLNNSKANSTEYRMLQRALALFGGEKKRLTPYFRQMNLTGGNNPHPFLHETRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFRKMLESWSDPLLAKWPELHGKVRLLIAVRNAFSHNQYPMYDEAVFSSIRKYDPSSPDAIEERMGLNIAHRLSEEVKQAKETVERIIQV

SEQ ID NO: 181 - protein, 1145 aa, unidentified
METQTIGHGIAYDHSKIQDKHFFGGFLNLAENNIKAVLKAFSEKFNVGNVDVKQFADVSLKDNLPDNDFQKRVSFLKMYFPVVDFINIPNNRAKFRSDLTTLFKSVDQLRNFYTHYYHKPLDFDASLFILLDDIFARTAKEVRDQKMKDDKTRQLLSKSLSEELQKGYELQLERLKELNRLGKKVNIHDQLGIKNGVLNNAFNHLIYKDGESFKTKLTYSSALTSFESAENGIEISQSGLLFLLSMFLKRKEIEDLKNRNKGFKAKVVIDEDGKVNGLKFMATHWVFSYLCFKGLKSKLSTEFHEETLLIQIIDELSKVPDELYCAFDKETRDKFIEDINEYVKEGHQDFSLEDAKVIHPVIRKRYENKFNYFAIRFLDEFVKFPSLRFQVHVGNYVHDRRIKNIDGTTFETERVVKDRIKVFGRLSEISSYKAQYLSSVSDKHDETGWEIFPNPSYVFINNNIPIHISVDTSFKKEIADFKKLRRAQVPDELKIRGAEKKRKFEITQMIGSKSVLNQEEPIALLSLNEIPALLYEILINGKEPAEIERIIKDKLNERQDVIKNYNPENWLPASQISRRLRSNKGERIINTDKLLQLVTKELLVTEQKLKIISDNREALKQKKEGKYIRKFIFTNSELGREAIWLADDIKRFMPADVRKEWKGYQHSQLQQSLAFYNSRPKEALAILESSWNLKDEKIIWNEWILKSFTQNKFFDAFYNEYLKGRKKYFAFLSEHIVQYTSNAKNLQKFIKQQMPKDLFEKRHYIIEDLQTEKNKILSKPFIFPRGIFDKKPTFIKGVKVEDSPESFANWYQYGYQKDHQFQKFYDWKRDYSDVFLEHLGKPFINNGDRRTLGMEELKERIIIKQDLKIKKIKIQDLFLRLIAENLFQKVFKYSAKLPLSDFYLTQEERMEKENMAALQNVREEGDKSPNIIKDNFIWSKMIPYKKGQIIENAVKLKDIGKLNVLSLDDKVQTLLSYDDAKPWSKIALENEFSIGENSYEVIRREKLFKEIQQFESEILFRSGWDGINHPAQLEDNRNPKFKMYIVNGILRKSAGLYSQGEDIWFEYNADFNNLDADVLETKSELVQLAFLVTAIRNKFAHNQLPAKEFYFYIRAKYGFADEPSVALVYLNFTKYAINEFKKVMI

SEQ ID NO: 182 - protein, 948 aa, Riemerella anatipestifer
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSEDLMLSKPIRKEIKKHGRVGFISRAITLYFKEKYQDKHQSFYNLSYKLEAKAPLLKREEHYEYWQQNKPQSPTESQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYHKTPIRTVYIREEHTKALKMGNFKALVKDRRLNGLFSFIKEENDTQKHPISQLRLRRELEIYQSLRVDAFKETLSLEEKLLNKHTSLSSLENEFRALLEEWKKEYAASSMVTDEHIAFIASVRNAFCHNQYPFYKEALHAPIPLFTVAQPTTEEKDGLGIAEALLKVLREYCEIVKSQI

SEQ ID NO: 183 - protein, 1175 aa, Porphyromonas gingivalis
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREEKVTEAGLLFFVSLFLEKRDAIWMQKKIRGFKGGTEAYQQMTNEVFCRSRISLPKLKLESLRTDDWMLLDMLNELVRCPKLLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRDLEAWSHSAARRIEDAFVGIEYASWENKKKIEQLLQDLSLWETFESKLKVKADKINIAKLKKEILEAKEHPYHDFKSWQKFERELRLVKNQDIITWMMCRDLMEENKVEGLDTGTLYLKDIRTDVQEQGSLNVLNHVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLDKWPDLQREVRLLIAVRNAFSHNQYPMYDETIFSSIRKYDPSSLDAIEERMGLNIAHRLSEEVKLAKEMVERIIQA

SEQ ID NO: 184 - protein, 1175 aa, Porphyromonas gingivalis
MTEQNEKPYNGTYYTLKDKHFWAAFFNLARHNAYITLTHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPMFDGNMLQRLYNVFDVSVQRVKRDHEHNDKVDPHRHFNHLVRKGKKDRCGNNDNPFFKHHFVDREGKVTEAGLLFFVSLFLEKRDAIWMQKKIRGFKGGTETYQQMTNEVFCRSRISLPKLKLESLRTDDWMLLDMLNELVRCPKSLYDRLREEDRACFRVPVDILSDEDDTDGAEEDPFKNTLVRHQDRFPYFALRYFDLKKVFTSLRFHIDLGTYHFAIYKKNIGEQPEDRHLTRNLYGFGRIQDFAEEHRPEEWKRLVRDLDCFETGDKPYITQTTPHYHIEKGKIGLRFVPEGQHLWPSPEVGATRTGRSKYAQDKRFTAEAFLSVHELMPMMFYYFLLREKYSEEVSAERVQGRIKRVIEDVYAVYDAFARDEINTRDELDACLADKGIRRGHLPRQMIAILSQKHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRDLEAWSHSAARRIEDAFAGIENASRENKKKIEQLLQDLSLWETFESKLKVKADKINIAKLKKEILEAKEHPYLDFKSWQKFERELRLVKNQDIITWMMCRDLMEENKVEGLDTGTLYLKDIRTDVQEQGSLNVLNHVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDENFRKMLESWSDPLLDKWPDLHRKVRLLIAVRNAFSHNQYPMYDEAVFSSIRKYDPSSPDAIEERMGLNIAHRLSEEVKQAKEMAERIIQA

SEQ ID NO: 185 - protein, 1213 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKVYDFLDDTLLDVLITIKKKKVKNDTSRELLKEKFRPELTQLKNQKREELIKKGKKLLEENLENAVFNHCLRPFLEENKTDDKQNKTVSLRKYRKSKPNEETSITLTQSGLVFLISFFLHRKEFQVFTSGLEGFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLGLVTEYKKNVYLKETSNIDLSRFPLFPSPSYVMANNNIPFYIDSRSNNLDEYLNQKKKAQSQNRKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLTKTISTDTSVTFENQPIDIPRLKNALQKELTLTQEKLLNVKQHEIEVDNYNRNKNTYKFKNQPKDKVDDNKLQRKYVFYRNEIGQEANWLASDLIHFMKNKSLWKGYMHNELQSFLAFFEDKKNDCIALLETVFNLKEDCILTKDLKNLFLKHGNFIDFYKEYLKLKEDFLNTESTFLENGFIGLPPKILKKELSKRLNYIFIVFQKRQFIIKELEEKKNNLYADAINLSRGIFDEKPTMIPFKKPNPDEFASWFVASYQYNNYQSFYELTPDKIENDKKKKYKNLRAINKVKIQDYYLKLMVDTLYQDLFNQPLDKSLSDFYVSKTDREKIKADAKAYQKRNDSFLWNKVIHLSLQNNRITANPKLKDIGKYKRALQDEKIATLLTYDDRTWTYALQKPEKENENDYKELHYTALNMELQEYEKVRSKKLLKQVQELEKQILDKFYDFSNNATHPEDLEIEDKKGKRHPNFKLYITKALLKNESEIINLENIDIEILIKYYDYNTEKLKEKIKNMDEDEKAKIVNTKENYNKITNVLIKKALVLIIIRNKMAHNQYPPKFIYDLATRFVPKKEEEYFACYFNRVFETITTELWENKKKAKEIV

SEQ ID NO: 186 - protein, 1119 aa, Porphyromonas gingivalis
MTEQNERPYNGTYYTLEDKHFWAAFFNLARHNAYITLTHIDRQLAYSKADITNDEDILFFKGQWKNLDNDLERKARLRSLILKHFSFLEGAAYGKKLFENKSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRCGNNDNPFFKHHFVDREGKVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMMCRDLMEENKVEGLDTGTLYLKDIRTEVQEQGSLNVLNRVKPMRLPVVVYRADSRGHVHKEQAPLATVYIEERDTKLLKQGNFKSFVKDRRLNGLFSFVDTGGLAMEQYPISKLRVEYELAKYQTARVCAFEQTLELEESLLTRCPHLPDKNFRKMLESWSDPLLDKWPDLQREVWLLIAVRNAFSHNQYPMYDEAVFSSIRKYDPSSPDAIEERMGLNIAHRLSEEVKQAKEMAERIIQA

SEQ ID NO: 187 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 188 - protein, 950 aa, Riemerella anatipestifer
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQSEKMTTEVFCRSRILLPKLRLESRYDHNQMLLDMLSELSRCPKLLYEKLSEKDKKCFQVEADGFLDEIEEEQNPFKDTLIRHQDRFPYFALRYLDLNESFKSIRFQVDLGTYHYCIYDKKIGYEQEKRHLTRTLLNFGRLQDFTEINRPQEWKALTKDLDYNETSNQPFISKTTPHYHITDNKIGFRLRTSKELYPSLEVKDGANRIAKYPYNSDFVAHAFISISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVVYDAQNQPIKSSKANSTESRLIRRALALYGGEKNRLEGYFKQTNLIGNTNPHPFLNKFNWKACRNLVDFYQQYLEQREKFLEAIKHQPWEPYQYCLLLKVPKENRKNLVKGWEQGGISLPRGLFTEAIRETLSKDLTLSKPIRKEIKKHGRVGFISRAITLYFKEKYQDKHQSFYNLSYKLEAKAPLLKKEEHYEYWQQNKPQSPTESQRLELHTSDRWKDYLLYKRWQHLEKKLRLYRNQDIMLWLMTLELTKNHFKELNLNYHQLKLENLAVNVQEADAKLNPLNQTLPMVLPVKVYPTTAFGEVQYHETPIRTVYIREEQTKALKMGNFKALVKDRHLNGLFSFIKEENDTQKHPISQLRLRRELEIYQSLRVDAFKETLSLEEKLLNKHASLSSLENEFRTLLEEWKKKYAASSMVTDKHIAFIASVRNAFCHNQYPFYKETLHAPILLFTVAQPTTEEKDGLGIAEALLRVLREYCEIVKSQI

SEQ ID NO: 189 - protein, 1213 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLRPFLEENKTDDKQNKTVSLRKYRKSKPNEETSITLTQSGLVFLMSFFLHRKEFQVFTSGLEGFKAKVNTIKEEKISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLGLVTEYKKNVYLKETSNIDLSRFPLFPSPSYVMANNNIPFYIDSRSNNLDEYLNQKKKAQSQNRKRNLTFEKYNKEQSKDAIIAMLQKEIGVKDLQQRSTIGLLSCNELPSMLYEVIVKDIKGAELENKIAQKIREQYQSIRDFTLNSPQKDNIPTTLIKTISTDTSVTFENQPIDIPRLKNAIQKELALTQEKLLNVKQHEIEVNNYNRNKNTYKFKNQPKDKVDDNKLQRKYVFYRNEIGQEANWLASDLIHFMKNKSLWKGYMHNELQSFLAFFEDKKNDCIALLETVFNLKEDCILTKDLKNLFLKHGNFIDFYKEYLKLKEDFLNTESTFLENGFIGLPPKILKKELSKRLNYIFIVFQKRQFIIKELEEKKNNLYADAINLSRGIFDEKPTMIPFKKPNPDEFASWFVASYQYNNYQSFYELTPDKIENDKKKKYKNLRAINKVKIQDYYLKLMVDTLYQDLFNQPLDKSLSDFYVSKTDREKIKADAKAYQKRNDSFLWNKVIHLSLQNNRITANPKLKDIGKYKRALQDEKIATLLTYDDRTWTYALQKPEKENENDYKELHYTALNMELQEYEKVRSKKLLKQVQELEKQILDKFYDFSNNATHPEDLEIEDKKGKRHPNFKLYITKALLKNESEIINLENIDIEILIKYYDYNTEKLKEKIKNMDEDEKAKIVNTKENYNKITNVLIKKALVLIIIRNKMAHNQYPPKFIYDLATRFVPKKEEEYFACYFNRVFETITTELWENKKKAKEIV

SEQ ID NO: 190 - protein, 1095 aa, Riemerella anatipestifer
MEKPLPPNVYTLKHKFFWGAFLNIARHNAFITICHINEQLGLTTPPNDDKIADVVCGTWNNILNNDHDLLKKSQLTELILKHFPFLAAMCYHPPKKEGKKKGSQKEQQKEKENEAQSQAEALNPSELIKVLKTLVKQLRTLRNYYSHHSHKKPDAEKDIFKHLYKAFDASLRMVKEDYKAHFTVNLTQDFAHLNRKGKNKQDNPDFDRYRFEKDGFFTESGLLFFTNLFLDKRDAYWMLKKVSGFKASHKQSEKMTTEVFCRSRILLPKLRLESRYDHNQMLLDMLSELSRYPKLLYEKLSEEDKKRFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSKQPFISKTTPHYHITDNKIGFRLGTSKELYPSLEVKDGANRIAQYPYNSDFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIESSKANSTEFQLIQRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSKDLTLSKPIRKEIKKHGRVGFISRAITLYFREKYQDDHQSFYDLPYKLEAKASPLPKKEHYEYWQQNKPQSPTELQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYQETPIRTVYIREEQTKALKMGNFKALVKDRRLNGLFSFIKEENDTQKHPISQLRLRRELEIYQSLRVDAFKETLNLEEKLLKKHTSLSSVENKFRILLEEWKKEYAASSMVTDEHIAFIASVRNAFCHNQYPFYEEALHAPIPLFTVAQQTTEEKDGLGIAEALLRVLREYCEIVKSQI

SEQ ID NO: 191 - protein, 1149 aa, Sinomicrobium oceani
MESTTTLGLHLKYQHDLFEDKHYFGGGVNLAVQNIESIFQAFAERYGIQNPLRKNGVPAINNIFHDNISISNYKEYLKFLKQYLPVVGFLEKSNEINIFEFREDFEILINAIYKLRHFYTHYYHSPIKLEDRFYTCLNELFVAVAIQVKKHKMKSDKTRQLLNKNLHQLLQQLIEQKREKLKDKKAEGEKVSLDTKSIENAVLNDAFVHLLDKDENIRLNYSSRLSEDIITKNGITLSISGLLFLLSLFLQRKEAEDLRSRIEGFKGKGNELRFMATHWVFSYLNVKRIKHRLNTDFQKETLLIQIADELSKVPDEVYKTLDHENRSKFLEDINEYIREGNEDASLNESTVVHGVIRKRYENKFHYLVLRYLDEFVDFPSLRFQVHLGNYIHDRRDKVIDGTNFITNRVIKEPIKVFGKLSHVSKLKSDYMESLSREHKNGWDVFPNPSYNFVGHNIPIFINLRSASSKGKELYRDLMKIKSEKKKKSREEGIPMERRDGKPTKIEISNQIDRNIKDNNFKDIYPGEPLAMLSLNELPALLFELLRRPSITPQDIEDRMVEKLYERFQIIRDYKPGDGLSTSKISKKLRKADNSTRLDGKKLLRAIQTETRNAREKLHTLEENKALQKNRKRRTVYTTREQGREASWLAQDLKRFMPIASRKEWRGYHHSQLQQILAFYDQNPKQPLELLEQFWDLKEDTYVWNSWIHKSLSQHNGFVPMYEGYLKGRLGYYKKLESDIIGFLEEHKVLKRYYTQQHLNVIFRERLYFIKTETKQKLELLARPLVFPRGIFDDKPTFVQDKKVVDHPELFADWYVYSYKDDHSFQEFYHYKRDYNEIFETELSWDIDFKDNKRQLNPSEQMDLFRMKWDLKIKKIKIQDIFLKIVAEDIYLKIFGHKIPLSLSDFYISRQERLTLDEQAVAQSMRLPGDTSENQIKESNLWQTTVPYEKEQIREPKIKLKDIGKFKYFLQQQKVLNLLKYDPQHVWTKAELEEELYIGKHSYEVVRREMLLQKCHQLEKHILEQFRFDGSNHPRELEQGNHPNFKMYIVNGILTKRGELEIEAENWWLELGNSKNSLDKVEVELLTMKTIPEQKAFLLILIRNKFAHNQLPADNYFHYASNLMNLKKSDTYSLFWFTVADTIVQEFMSL

SEQ ID NO: 192 - protein, 1133 aa, Reichenbachiella agariperforans
MKTNPLIASSGEKPNYKKFNTESDKSFKKIFQNKGSIAPIAEKACKNFEIKSKSPVNRDGRLHYFSVGHAFKNIDSKNVFRYELDESQMDMKPTQFLALQKEFFDFQGALNGLLKHIRNVNSHYVHTFEKLEIQSINQKLITFLIEAFELAVIHSYLNEEELSYEAYKDDPQSGQKLVQFLCDKFYPNKEHEVEERKTILAKNKRQALEHLLFIEVTSDIDWKLFEKHKVFTISNGKYLSFHACLFLLSLFLYKSEANQLISKIKGFKRNDDNQYRSKRQIFTFFSKKFTSQDVNSEEQHLVKFRDVIQYLNHYPSAWNKHLELKSGYPQMTDKLMRYIVEAEIYRSFPDQTDNHRFLLFAIREFFGQSCLDTWTGNTPINFSNQEQKGFSYEINTSAEIKDIETKLKALVLKGPLNFKEKKEQNRLEKDLRREKKEQPTNRVKEKLLTRIQHNMLYVSYGRNQDRFMDFAARFLAETDYFGKDAKFKMYQFYTSDEQRDHLKEQKKELPKKEFEKLKYHQSKLVDYFTYAEQQARYPDWDTPFVVENNAIQIKVTLFNGAKKIVSVQRNLMLYLLEDALYSEKRENAGKGLISGYFVHHQKELKDQLDILEKETEISREQKREFKKLLPKRLLHRYSPAQINDTTEWNPMEVILEEAKAQEQRYQLLLEKAILHQTEEDFLKRNKGKQFKLRFVRKAWHLMYLKELYMNKVAEHGHHKSFHITKEEFNDFCRWMFAFDEVPKYKEYLCDYFSQKGFFNNAEFKDLIESSTSLNDLYEKTKQRFEGWSKDLTKQSDENKYLLANYESMLKDDMLYVNISHFISYLESKGKINRNAHGHIAYKALNNVPHLIEEYYYKDRLAPEEYKSHGKLYNKLKTVKLEDALLYEMAMHYLSLEPALVPKVKTKVKDILSSNIAFDIKDAAGHHLYHLLIPFHKIDSFVALINHQSQQEKDPDKTSFLAKIQPYLEKVKNSKDLKAVYHYYKDTPHTLRYEDLNMIHSHIVSQSVQFTKVALKLEEYFIAKKSITLQIARQISYSEIADLSNYFTDEVRNTAFHFDVPETAYSMILQGIESEFLDREIKPQKPKSLSELSTQQVSVCTAFLETLHNNLFDRKDDKKERLSKARERYFEQIN

SEQ ID NO: 193 - protein, 1340 aa, Lachnospiraceae bacterium
MQISKVNHKHVAVGQKDRERITGFIYNDPVGDEKSLEDVVAKRANDTKVLFNVFNTKDLYDSQESDKSEKDKEIISKGAKFVAKSFNSAITILKKQNKIYSTLTSQQVIKELKDKFGGARIYDDDIEEALTETLKKSFRKENVRNSIKVLIENAAGIRSSLSKDEEELIQEYFVKQLVEEYTKTKLQKNVVKSIKNQNMVIQPDSDSQVLSLSESRREKQSSAVSSDTLVNCKEKDVLKAFLTDYAVLDEDERNSLLWKLRNLVNLYFYGSESIRDYSYTKEKSVWKEHDEQKANKTLFIDEICHITKIGKNGKEQKVLDYEENRSRCRKQNINYYRSALNYAKNNTSGIFENEDSNHFWIHLIENEVERLYNGIENGEEFKFETGYISEKVWKAVINHLSIKYIALGKAVYNYAMKELSSPGDIEPGKIDDSYINGITSFDYEIIKAEESLQRDISMNVVFATNYLACATVDTDKDFLLFSKEDIRSCTKKDGNLCKNIMQFWGGYSTWKNFCEEYLKDDKDALELLYSLKSMLYSMRNSSFHFSTENVDNGSWDTELIGKLFEEDCNRAARIEKEKFYNNNLHMFYSSSLLEKVLERLYSSHHERASQVPSFNRVFVRKNFPSSLSEQRITPKFTDSKDEQIWQSAVYYLCKEIYYNDFLQSKEAYKLFREGVKNLDKNDINNQKAADSFKQAVVYYGKAIGNATLSQVCQAIMTEYNRQNNDGLKKKSAYAEKQNSNKYKHYPLFLKQVLQSAFWEYLDENKEIYGFISAQIHKSNVEIKAEDFIANYSSQQYKKLVDKVKKTPELQKWYTLGRLINPRQANQFLGSIRNYVQFVKDIQRRAKENGNPIRNYYEVLESDSIIKILEMCTKLNGTTSNDIHDYFRDEDEYAEYISQFVNFGDVHSGAALNAFCNSESEGKKNGIYYDGINPIVNRNWVLCKLYGSPDLISKIISRVNENMIHDFHKQEDLIREYQIKGICSNKKEQQDLRTFQVLKNRVELRDIVEYSEIINELYGQLIKWCYLRERDLMYFQLGFHYLCLNNASSKEADYIKINVDDRNISGAILYQIAAMYINGLPVYYKKDDMYVALKSGKKASDELNSNEQTSKKINYFLKYGNNILGDKKDQLYLAGLELFENVAEHENIIIFRNEIDHFHYFYDRDRSMLDLYSEVFDRFFTYDMKLRKNVVNMLYNILLDHNIVSSFVFETGEKKVGRGDSEVIKPSAKIRLRANNGVSSDVFTYKVGSKDELKIATLPAKNEEFLLNVARLIYYPDMEAVSENMVREGVVKVEKSNDKKGKISRGSNTRSSNQSKYNNKSKNRMNYSMGSIFEKMDLKFD

SEQ ID NO: 194 - protein, 1437 aa, Lachnospiraceae bacterium
MKISKVREENRGAKLTVNAKTAVVSENRSQEGILYNDPSRYGKSRKNDEDRDRYIESRLKSSGKLYRIFNEDKNKRETDELQWFLSEIVKKINRRNGLVLSDMLSVDDRAFEKAFEKYAELSYTNRRNKVSGSPAFETCGVDAATAERLKGIISETNFINRIKNNIDNKVSEDIIDRIIAKYLKKSLCRERVKRGLKKLLMNAFDLPYSDPDIDVQRDFIDYVLEDFYHVRAKSQVSRSIKNMNMPVQPEGDGKFAITVSKGGTESGNKRSAEKEAFKKFLSDYASLDERVRDDMLRRMRRLVVLYFYGSDDSKLSDVNEKFDVWEDHAARRVDNREFIKLPLENKLANGKTDKDAERIRKNTVKELYRNQNIGCYRQAVKAVEEDNNGRYFDDKMLNMFFIHRIEYGVEKIYANLKQVTEFKARTGYLSEKIWKDLINYISIKYIAMGKAVYNYAMDELNASDKKEIELGKISEEYLSGISSFDYELIKAEEMLQRETAVYVAFAARHLSSQTVELDSENSDFLLLKPKGTMDKNDKNKLASNNILNFLKDKETLRDTILQYFGGHSLWTDFPFDKYLAGGKDDVDFLTDLKDVIYSMRNDSFHYATENHNNGKWNKELISAMFEHETERMTVVMKDKFYSNNLPMFYKNDDLKKLLIDLYKDNVERASQVPSFNKVFVRKNFPALVRDKDNLGIELDLKADADKGENELKFYNALYYMFKEIYYNAFLNDKNVRERFITKATKVADNYDRNKERNLKDRIKSAGSDEKKKLREQLQNYIAENDFGQRIKNIVQVNPDYTLAQICQLIMTEYNQQNNGCMQKKSAARKDINKDSYQHYKMLLLVNLRKAFLEFIKENYAFVLKPYKHDLCDKADFVPDFAKYVKPYAGLISRVAGSSELQKWYIVSRFLSPAQANHMLGFLHSYKQYVWDIYRRASETGTEINHSIAEDKIAGVDITDVDAVIDLSVKLCGTISSEISDYFKDDEVYAEYISSYLDFEYDGGNYKDSLNRFCNSDAVNDQKVALYYDGEHPKLNRNIILSKLYGERRFLEKITDRVSRSDIVEYYKLKKETSQYQTKGIFDSEDEQKNIKKFQEMKNIVEFRDLMDYSEIADELQGQLINWIYLRERDLMNFQLGYHYACLNNDSNKQATYVTLDYQGKKNRKINGAILYQICAMYINGLPLYYVDKDSSEWTVSDGKESTGAKIGEFYRYAKSFENTSDCYASGLEIFENISEHDNITELRNYIEHFRYYSSFDRSFLGIYSEVFDRFFTYDLKYRKNVPTILYNILLQHFVNVRFEFVSGKKMIGIDKKDRKIAKEKECARITIREKNGVYSEQFTYKLKNGTVYVDARDKRYLQSIIRLLFYPEKVNMDEMIEVKEKKKPSDNNTGKGYSKRDRQQDRKEYDKYKEKKKKEGNFLSGMGGNINWDEINAQLKN

SEQ ID NO: 195 - protein, 1385 aa, Clostridium aminophilum
MKFSKVDHTRSAVGIQKATDSVHGMLYTDPKKQEVNDLDKRFDQLNVKAKRLYNVFNQSKAEEDDDEKRFGKVVKKLNRELKDLLFHREVSRYNSIGNAKYNYYGIKSNPEEIVSNLGMVESLKGERDPQKVISKLLLYYLRKGLKPGTDGLRMILEASCGLRKLSGDEKELKVFLQTLDEDFEKKTFKKNLIRSIENQNMAVQPSNEGDPIIGITQGRFNSQKNEEKSAIERMMSMYADLNEDHREDVLRKLRRLNVLYFNVDTEKTEEPTLPGEVDTNPVFEVWHDHEKGKENDRQFATFAKILTEDRETRKKEKLAVKEALNDLKSAIRDHNIMAYRCSIKVTEQDKDGLFFEDQRINRFWIHHIESAVERILASINPEKLYKLRIGYLGEKVWKDLLNYLSIKYIAVGKAVFHFAMEDLGKTGQDIELGKLSNSVSGGLTSFDYEQIRADETLQRQLSVEVAFAANNLFRAVVGQTGKKIEQSKSEENEEDFLLWKAEKIAESIKKEGEGNTLKSILQFFGGASSWDLNHFCAAYGNESSALGYETKFADDLRKAIYSLRNETFHFTTLNKGSFDWNAKLIGDMFSHEAATGIAVERTRFYSNNLPMFYRESDLKRIMDHLYNTYHPRASQVPSFNSVFVRKNFRLFLSNTLNTNTSFDTEVYQKWESGVYYLFKEIYYNSFLPSGDAHHLFFEGLRRIRKEADNLPIVGKEAKKRNAVQDFGRRCDELKNLSLSAICQMIMTEYNEQNNGNRKVKSTREDKRKPDIFQHYKMLLLRTLQEAFAIYIRREEFKFIFDLPKTLYVMKPVEEFLPNWKSGMFDSLVERVKQSPDLQRWYVLCKFLNGRLLNQLSGVIRSYIQFAGDIQRRAKANHNRLYMDNTQRVEYYSNVLEVVDFCIKGTSRFSNVFSDYFRDEDAYADYLDNYLQFKDEKIAEVSSFAALKTFCNEEEVKAGIYMDGENPVMQRNIVMAKLFGPDEVLKNVVPKVTREEIEEYYQLEKQIAPYRQNGYCKSEEDQKKLLRFQRIKNRVEFQTITEFSEIINELLGQLISWSFLRERDLLYFQLGFHYLCLHNDTEKPAEYKEISREDGTVIRNAILHQVAAMYVGGLPVYTLADKKLAAFEKGEADCKLSISKDTAGAGKKIKDFFRYSKYVLIKDRMLTDQNQKYTIYLAGLELFENTDEHDNITDVRKYVDHFKYYATSDENAMSILDLYSEIHDRFFTYDMKYQKNVANMLENILLRHFVLIRPEFFTGSKKVGEGKKITCKARAQIEIAENGMRSEDFTYKLSDGKKNISTCMIAARDQKYLNTVARLLYYPHEAKKSIVDTREKKNNKKTNRGDGTFNKQKGTARKEKDNGPREFNDTGFSNTPFAGFDPFRNS

SEQ ID NO: 196 - protein, 1175 aa, Carnobacterium gallinarum
MRITKVKIKLDNKLYQVTMQKEEKYGTLKLNEESRKSTAEILRLKKASFNKSFHSKTINSQKENKNATIKKNGDYISQIFEKLVGVDTNKNIRKPKMSLTDLKDLPKKDLALFIKRKFKNDDIVEIKNLDLISLFYNALQKVPGEHFTDESWADFCQEMMPYREYKNKFIERKIILLANSIEQNKGFSINPETFSKRKRVLHQWAIEVQERGDFSILDEKLSKLAEIYNFKKMCKRVQDELNDLEKSMKKGKNPEKEKEAYKKQKNFKIKTIWKDYPYKTHIGLIEKIKENEELNQFNIEIGKYFEHYFPIKKERCTEDEPYYLNSETIATTVNYQLKNALISYLMQIGKYKQFGLENQVLDSKKLQEIGIYEGFQTKFMDACVFATSSLKNIIEPMRSGDILGKREFKEAIATSSFVNYHHFFPYFPFELKGMKDRESELIPFGEQTEAKQMQNIWALRGSVQQIRNEIFHSFDKNQKFNLPQLDKSNFEFDASENSTGKSQSYIETDYKFLFEAEKNQLEQFFIERIKSSGALEYYPLKSLEKLFAKKEMKFSLGSQVVAFAPSYKKLVKKGHSYQTATEGTANYLGLSYYNRYELKEESFQAQYYLLKLIYQYVFLPNFSQGNSPAFRETVKAILRINKDEARKKMKKNKKFLRKYAFEQVREMEFKETPDQYMSYLQSEMREEKVRKAEKNDKGFEKNITMNFEKLLMQIFVKGFDVFLTTFAGKELLLSSEEKVIKETEISLSKKINEREKTLKASIQVEHQLVATNSAISYWLFCKLLDSRHLNELRNEMIKFKQSRIKFNHTQHAELIQNLLPIVELTILSNDYDEKNDSQNVDVSAYFEDKSLYETAPYVQTDDRTRVSFRPILKLEKYHTKSLIEALLKDNPQFRVAATDIQEWMHKREEIGELVEKRKNLHTEWAEGQQTLGAEKREEYRDYCKKIDRFNWKANKVTLTYLSQLHYLITDLLGRMVGFSALFERDLVYFSRSFSELGGETYHISDYKNLSGVLRLNAEVKPIKIKNIKVIDNEENPYKGNEPEVKPFLDRLHAYLENVIGIKAVHGKIRNQTAHLSVLQLELSMIESMNNLRDLMAYDRKLKNAVTKSMIKILDKHGMILKLKIDENHKNFEIESLIPKEIIHLKDKAIKTNQVSEEYCQLVLALLTTNPGNQLN

SEQ ID NO: 197 - protein, 1164 aa, Carnobacterium gallinarum
MRMTKVKINGSPVSMNRSKLNGHLVWNGTTNTVNILTKKEQSFAASFLNKTLVKADQVKGYKVLAENIFIIFEQLEKSNSEKPSVYLNNIRRLKEAGLKRFFKSKYHEEIKYTSEKNQSVPTKLNLIPLFFNAVDRIQEDKFDEKNWSYFCKEMSPYLDYKKSYLNRKKEILANSIQQNRGFSMPTAEEPNLLSKRKQLFQQWAMKFQESPLIQQNNFAVEQFNKEFANKINELAAVYNVDELCTAITEKLMNFDKDKSNKTRNFEIKKLWKQHPHNKDKALIKLFNQEGNEALNQFNIELGKYFEHYFPKTGKKESAESYYLNPQTIIKTVGYQLRNAFVQYLLQVGKLHQYNKGVLDSQTLQEIGMYEGFQTKFMDACVFASSSLRNIIQATTNEDILTREKFKKELEKNVELKHDLFFKTEIVEERDENPAKKIAMTPNELDLWAIRGAVQRVRNQIFHQQINKRHEPNQLKVGSFENGDLGNVSYQKTIYQKLFDAEIKDIEIYFAEKIKSSGALEQYSMKDLEKLFSNKELTLSLGGQVVAFAPSYKKLYKQGYFYQNEKTIELEQFTDYDFSNDVFKANYYLIKLIYHYVFLPQFSQANNKLFKDTVHYVIQQNKELNTTEKDKKNNKKIRKYAFEQVKLMKNESPEKYMQYLQREMQEERTIKEAKKTNEEKPNYNFEKLLIQIFIKGFDTFLRNFDLNLNPAEELVGTVKEKAEGLRKRKERIAKILNVDEQIKTGDEEIAFWIFAKLLDARHLSELRNEMIKFKQSSVKKGLIKNGDLIEQMQPILELCILSNDSESMEKESFDKIEVFLEKVELAKNEPYMQEDKLTPVKFRFMKQLEKYQTRNFIENLVIENPEFKVSEKIVLNWHEEKEKIADLVDKRTKLHEEWASKAREIEEYNEKIKKNKSKKLDKPAEFAKFAEYKIICEAIENFNRLDHKVRLTYLKNLHYLMIDLMGRMVGFSVLFERDFVYMGRSYSALKKQSIYLNDYDTFANIRDWEVNENKHLFGTSSSDLTFQETAEFKNLKKPMENQLKALLGVTNHSFEIRNNIAHLHVLRNDGKGEGVSLLSCMNDLRKLMSYDRKLKNAVTKAIIKILDKHGMILKLTNNDHTKPFEIESLKPKKIIHLEKSNHSFPMDQVSQEYCDLVKKMLVFTN

SEQ ID NO: 198 - protein, 1154 aa, Paludibacter propionicigenes
MRVSKVKVKDGGKDKMVLVHRKTTGAQLVYSGQPVSNETSNILPEKKRQSFDLSTLNKTIIKFDTAKKQKLNVDQYKIVEKIFKYPKQELPKQIKAEEILPFLNHKFQEPVKYWKNGKEESFNLTLLIVEAVQAQDKRKLQPYYDWKTWYIQTKSDLLKKSIENNRIDLTENLSKRKKALLAWETEFTASGSIDLTHYHKVYMTDVLCKMLQDVKPLTDDKGKINTNAYHRGLKKALQNHQPAIFGTREVPNEANRADNQLSIYHLEVVKYLEHYFPIKTSKRRNTADDIAHYLKAQTLKTTIEKQLVNAIRANIIQQGKTNHHELKADTTSNDLIRIKTNEAFVLNLTGTCAFAANNIRNMVDNEQTNDILGKGDFIKSLLKDNTNSQLYSFFFGEGLSTNKAEKETQLWGIRGAVQQIRNNVNHYKKDALKTVFNISNFENPTITDPKQQTNYADTIYKARFINELEKIPEAFAQQLKTGGAVSYYTIENLKSLLTTFQFSLCRSTIPFAPGFKKVFNGGINYQNAKQDESFYELMLEQYLRKENFAEESYNARYFMLKLIYNNLFLPGFTTDRKAFADSVGFVQMQNKKQAEKVNPRKKEAYAFEAVRPMTAADSIADYMAYVQSELMQEQNKKEEKVAEETRINFEKFVLQVFIKGFDSFLRAKEFDFVQMPQPQLTATASNQQKADKLNQLEASITADCKLTPQYAKADDATHIAFYVFCKLLDAAHLSNLRNELIKFRESVNEFKFHHLLEIIEICLLSADVVPTDYRDLYSSEADCLARLRPFIEQGADITNWSDLFVQSDKHSPVIHANIELSVKYGTTKLLEQIINKDTQFKTTEANFTAWNTAQKSIEQLIKQREDHHEQWVKAKNADDKEKQERKREKSNFAQKFIEKHGDDYLDICDYINTYNWLDNKMHFVHLNRLHGLTIELLGRMAGFVALFDRDFQFFDEQQIADEFKLHGFVNLHSIDKKLNEVPTKKIKEIYDIRNKIIQINGNKINESVRANLIQFISSKRNYYNNAFLHVSNDEIKEKQMYDIRNHIAHFNYLTKDAADFSLIDLINELRELLHYDRKLKNAVSKAFIDLFDKHGMILKLKLNADHKLKVESLEPKKIYHLGSSAKDKPEYQYCTNQVMMAYCNMCRSLLEMKK

SEQ ID NO: 199 - protein, 970 aa, Listeria weihenstephanensis
MLALLHQEVPSQKLHNLKSLNTESLTKLFKPKFQNMISYPPSKGAEHVQFCLTDIAVPAIRDLDEIKPDWGIFFEKLKPYTDWAESYIHYKQTTIQKSIEQNKIQSPDSPRKLVLQKYVTAFLNGEPLGLDLVAKKYKLADLAESFKVVDLNEDKSANYKIKACLQQHQRNILDELKEDPELNQYGIEVKKYIQRYFPIKRAPNRSKHARADFLKKELIESTVEQQFKNAVYHYVLEQGKMEAYELTDPKTKDLQDIRSGEAFSFKFINACAFASNNLKMILNPECEKDILGKGDFKKNLPNSTTQSDVVKKMIPFFSDEIQNVNFDEAIWAIRGSIQQIRNEVYHCKKHSWKSILKIKGFEFEPNNMKYTDSDMQKLMDKDIAKIPDFIEEKLKSSGIIRFYSHDKLQSIWEMKQGFSLLTTNAPFVPSFKRVYAKGHDYQTSKNRYYDLGLTTFDILEYGEEDFRARYFLTKLVYYQQFMPWFTADNNAFRDAANFVLRLNKNRQQDAKAFINIREVEEGEMPRDYMGYVQGQIAIHEDSTEDTPNHFEKFISQVFIKGFDSHMRSADLKFIKNPRNQGLEQSEIEEMSFDIKVEPSFLKNKDDYIAFWTFCKMLDARHLSELRNEMIKYDGHLTGEQEIIGLALLGVDSRENDWKQFFSSEREYEKIMKGYVGEELYQREPYRQSDGKTPILFRGVEQARKYGTETVIQRLFDASPEFKVSKCNITEWERQKETIEETIERRKELHNEWEKNPKKPQNNAFFKEYKECCDAIDAYNWHKNKTTLVYVNELHHLLIEILGRYVGYVAIADRDFQCMANQYFKHSGITERVEYWGDNRLKSIKKLDTFLKKEGLFVSEKNARNHIAHLNYLSLKSECTLLYLSERLREIFKYDRKLKNAVSKSLIDILDRHGMSVVFANLKENKHRLVIKSLEPKKLRHLGEKKIDNGYIETNQVSEEYCGIVKRLLEI

SEQ ID NO: 200 - protein, 1051 aa, unidentified
MKITKMRVDGRTIVMERTSKEGQLGYEGIDGNKTTEIIFDKKKESFYKSILNKTVRKPDEKEKNRRKQAINKAINKEITELMLAVLHQEVPSQKLHNLKSLNTESLTKLFKPKFQNMISYPPSKGAEHVQFCLTDIAVPAIRDLDEIKPDWGIFFEKLKPYTDWAESYIHYKQTTIQKSIEQNKIQSPDSPRKLVLQKYVTAFLNGEPLGLDLVAKKYKLADLAESFKLVDLNEDKSANYKIKACLQQHQRNILDELKEDPELNQYGIEVKKYIQRYFPIKRAPNRSKHARADFLKKELIESTVEQQFKNAVYHYVLEQGKMEAYELTDPKTKDLQDIRSGEAFSFKFINACAFASNNLKMILNPECEKDILGKGNFKKNLPNSTTRSDVVKKMIPFFSDELQNVNFDEAIWAIRGSIQQIRNEVYHCKKHSWKSILKIKGFEFEPNNMKYADSDMQKLMDKDIAKIPEFIEEKLKSSGVVRFYRHDELQSIWEMKQGFSLLTTNAPFVPSFKRVYAKGHDYQTSKNRYYNLDLTTFDILEYGEEDFRARYFLTKLVYYQQFMPWFTADNNAFRDAANFVLRLNKNRQQDAKAFINIREVEEGEMPRDYMGYVQGQIAIHEDSIEDTPNHFEKFISQVFIKGFDRHMRSANLKFIKNPRNQGLEQSEIEEMSFDIKVEPSFLKNKDDYIAFWIFCKMLDARHLSELRNEMIKYDGHLTGEQEIIGLALLGVDSRENDWKQFFSSEREYEKIMKGYVVEELYQREPYRQSDGKTPILFRGVEQARKYGTETVIQRLFDANPEFKVSKCNLAEWERQKETIEETIKRRKELHNEWAKNPKKPQNNAFFKEYKECCDAIDAYNWHKNKTTLAYVNELHHLLIEILGRYVGYVAIADRDFQCMANQYFKHSGITERVEYWGDNRLKSIKKLDTFLKKEGLFVSEKNARNHIAHLNYLSLKSECTLLYLSERLREIFKYDRKLKNAVSKSLIDILDRHGMSVVFANLKENKHRLVIKSLEPKKLRHLGGKKIDGGYIETNQVSEEYCGIVKRLLEM

SEQ ID NO: 201 - protein, 1152 aa, Leptotrichia wadei
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENDITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALE

SEQ ID NO: 202 - protein, 1285 aa, Rhodobacter capsulatus
MQIGKVQGRTISEFGDPAGGLKRKISTDGKNRKELPAHLSSDPKALIGQWISGIDKIYRKPDSRKSDGKAIHSPTPSKMQFDARDDLGEAFWKLVSEAGLAQDSDYDQFKRRLHPYGDKFQPADSGAKLKFEADPPEPQAFHGRWYGAMSKRGNDAKELAAALYEHLHVDEKRIDGQPKRNPKTDKFAPGLVVARALGIESSVLPRGMARLARNWGEEEIQTYFVVDVAASVKEVAKAAVSAAQAFDPPRQVSGRSLSPKVGFALAEHLERVTGSKRCSFDPAAGPSVLALHDEVKKTYKRLCARGKNAARAFPADKTELLALMRHTHENRVRNQMVRMGRVSEYRGQQAGDLAQSHYWTSAGQTEIKESEIFVRLWVGAFALAGRSMKAWIDPMGKIVNTEKNDRDLTAAVNIRQVISNKEMVAEAMARRGIYFGETPELDRLGAEGNEGFVFALLRYLRGCRNQTFHLGARAGFLKEIRKELEKTRWGKAKEAEHVVLTDKTVAAIRAIIDNDAKALGARLLADLSGAFVAHYASKEHFSTLYSEIVKAVKDAPEVSSGLPRLKLLLKRADGVRGYVHGLRDTRKHAFATKLPPPPAPRELDDPATKARYIALLRLYDGPFRAYASGITGTALAGPAARAKEAATALAQSVNVTKAYSDVMEGRTSRLRPPNDGETLREYLSALTGETATEFRVQIGYESDSENARKQAEFIENYRRDMLAFMFEDYIRAKGFDWILKIEPGATAMTRAPVLPEPIDTRGQYEHWQAALYLVMHFVPASDVSNLLHQLRKWEALQGKYELVQDGDATDQADARREALDLVKRFRDVLVLFLKTGEARFEGRAAPFDLKPFRALFANPATFDRLFMATPTTARPAEDDPEGDGASEPELRVARTLRGLRQIARYNHMAVLSDLFAKHKVRDEEVARLAEIEDETQEKSQIVAAQELRTDLHDKVMKCHPKTISPEERQSYAAAIKTIEEHRFLVGRVYLGDHLRLHRLMMDVIGRLIDYAGAYERDTGTFLINASKQLGAGADWAVTIAGAANTDARTQTRKDLAHFNVLDRADGTPDLTALVNRAREMMAYDRKRKNAVPRSILDMLARLGLTLKWQMKDHLLQDATITQAAIKHLDKVRLTVGGPAAVTEARFSQDYLQMVAAVFNGSVQNPKPRRRDDGDAWHKPPKPATAQSQPDQKPPNKAPSAGSRLPPPQVGEVYEGVVVKVIDTGSLGFLAVEGVAGNIGLHISRLRRIREDAIIVGRRYRFRVEIYVPPKSNTSKLNAADLVRID

SEQ ID NO: 203 - protein, 1285 aa, Rhodobacter capsulatus
MQIGKVQGRTISEFGDPAGGLKRKISTDGKNRKELPAHLSSDPKALIGQWISGIDKIYRKPDSRKSDGKAIHSPTPSKMQFDARDDLGEAFWKLVSEAGLAQDSDYDQFKRRLHPYGDKFQPADSGAKLKFEADPPEPQAFHGRWYGAMSKRGNDAKELAAALYEHLHVDEKRIDGQPKRNPKTDKFAPGLVVARALGIESSVLPRGMARLARNWGEEEIQTYFVVDVAASVKEVAKAAVSAAQAFDPPRQVSGRSLSPKVGFALAEHLERVTGSKRCSFDPAAGPSVLALHDEVKKTYKRLCARGKNAARAFPADKTELLALMRHTHENRVRNQMVRMGRVSEYRGQQAGDLAQSHYWTSAGQTEIKESEIFVRLWVGAFALAGRSMKAWIDPMGKIVNTEKNDRDLTAAVNIRQVISNKEMVAEAMARRGIYFGETPELDRLGAEGNEGFVFALLRYLRGCRNQTFHLGARAGFLKEIRKELEKTRWGKAKEAEHVVLTDKTVAAIRAIIDNDAKALGARLLADLSGAFVAHYASKEHFSTLYSEIVKAVKDAPEVSSGLPRLKLLLKRADGVRGYVHGLRDTRKHAFATKLPPPPAPRELDDPATKARYIALLRLYDGPFRAYASGITGTALAGPAARAKEAATALAQSVNVTKAYSDVMEGRSSRLRPPNDGETLREYLSALTGETATEFRVQIGYESDSENARKQAEFIENYRRDMLAFMFEDYIRAKGFDWILKIEPGATAMTRAPVLPEPIDTRGQYEHWQAALYLVMHFVPASDVSNLLHQLRKWEALQGKYELVQDGDATDQADARREALDLVKRFRDVLVLFLKTGEARFEGRAAPFDLKPFRALFANPATFDRLFMATPTTARPAEDDPEGDGASEPELRVARTLRGLRQIARYNHMAVLSDLFAKHKVRDEEVARLAEIEDETQEKSQIVAAQELRTDLHDKVMKCHPKTISPEERQSYAAAIKTIEEHRFLVGRVYLGDHLRLHRLMMDVIGRLIDYAGAYERDTGTFLINASKQLGAGADWAVTIAGAANTDARTQTRKDLAHFNVLDRADGTPDLTALVNRAREMMAYDRKRKNAVPRSILDMLARLGLTLKWQMKDHLLQDATITQAAIKHLDKVRLTVGGPAAVTEARFSQDYLQMVAAVFNGSVQNPKPRRRDDGDAWHKPPKPATAQSQPDQKPPNKAPSAGSRLPPPQVGEVYEGVVVKVIDTGSLGFLAVEGVAGNIGLHISRLRRIREDAIIVGRRYRFRVEIYVPPKSNTSKLNAADLVRID

SEQ ID NO: 204 - protein, 1285 aa, Rhodobacter capsulatus; identical to SEQ ID NO: 203

SEQ ID NO: 205 - protein, 1389 aa, unidentified
  REGION 1..1389: note = Synthetic
MGNLFGHKRWYEVRDKKDFKIKRKVKVKRNYDGNKYILNINENNNKEKIDNNKFIRKYINYKKNDNILKEFTRKFHAGNILFKLKGKEGIIRIENNDDFLETEEVVLYIEAYGKSEKLKALGITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDDKIDVILTNFMEIREKIKSNLEILGFVKFYLNVGGDKKKSKNKKMLVEKILNINVDLTVEDIADFVIKELEFWNITKRIEKVKKVNNEFLEKRRNRTYIKSYVLLDKHEKFKIERENKKDKIVKFFVENIKNNSIKEKIEKILAEFKIDELIKKLEKELKKGNCDTEIFGIFKKHYKVNFDSKKFSKKSDEEKELYKIIYRYLKGRIEKILVNEQKVRLKKMEKIEIEKILNESILSEKILKRVKQYTLEHIMYLGKLRHNDIDMTTVNTDDFSRLHAKEELDLELITFFASTNMELNKIFSRENINNDENIDFFGGDREKNYVLDKKILNSKIKIIRDLDFIDNKNNITNNFIRKFTKIGTNERNRILHAISKERDLQGTQDDYNKVINIIQNLKISDEEVSKALNLDVVFKDKKNIITKINDIKISEENNNDIKYLPSFSKVLPEILNLYRNNPKNEPFDTIETEKIVLNALIYVNKELYKKLILEDDLEENESKNIFLQELKKTLGNIDEIDENIIENYYKNAQISASKGNNKAIKKYQKKVIECYIGYLRKNYEELFDFSDFKMNIQEIKKQIKDINDNKTYERITVKTSDKTIVINDDFEYIISIFALLNSNAVINKIRNRFFATSVWLNTSEYQNIIDILDEIMQLNTLRNECITENWNLNLEEFIQKMKEIEKDFDDFKIQTKKEIFNNYYEDIKNNILTEFKDDINGCDVLEKKLEKIVIFDDETKFEIDKKSNILQDEQRKLSNINKKDLKKKVDQYIKDKDQEIKSKILCRIIFNSDFLKKYKKEIDNLIEDMESENENKFQEIYYPKERKNELYIYKKNLFLNIGNPNFDKIYGLISNDIKMADAKFLFNIDGKNIRKNKISEIDAILKNLNDKLNGYSKEYKEKYIKKLKENDDFFAKNIQNKNYKSFEKDYNRVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFKLIGNNDILERLMKPKKVSVLELESYNSDYIKNLIIELLTKIENTNDTL

SEQ ID NO: 206 - protein, 1197 aa, unidentified
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENDITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALEKRPAATKKAGQAKKKKGSYPYDVPDYAYPYDVPDYAYPYDVPDYA

SEQ ID NO: 207 - protein, 1120 aa, Listeria seeligeri
MWISIKTLIHHLGVLFFCDYMYNRREKKIIEVKTMRITKVEVDRKKVLISRDKNGGKLVYENEMQDNTEQIMHHKKSSFYKSVVNKTICRPEQKQMKKLVHGLLQENSQEKIKVSDVTKLNISNFLNHRFKKSLYYFPENSPDKSEEYRIEINLSQLLEDSLKKQQGTFICWESFSKDMELYINWAENYISSKTKLIKKSIRNNRIQSTESRSGQLMDRYMKDILNKNKPFDIQSVSEKYQLEKLTSALKATFKEAKKNDKEINYKLKSTLQNHERQIIEELKENSELNQFNIEIRKHLETYFPIKKTNRKVGDIRNLEIGEIQKIVNHRLKNKIVQRILQEGKLASYEIESTVNSNSLQKIKIEEAFALKFINACLFASNNLRNMVYPVCKKDILMIGEFKNSFKEIKHKKFIRQWSQFFSQEITVDDIELASWGLRGAIAPIRNEIIHLKKHSWKKFFNNPTFKVKKSKIINGKTKDVTSEFLYKETLFKDYFYSELDSVPELIINKMESSKILDYYSSDQLNQVFTIPNFELSLLTSAVPFAPSFKRVYLKGFDYQNQDEAQPDYNLKLNIYNEKAFNSEAFQAQYSLFKMVYYQVFLPQFTTNNDLFKSSVDFILTLNKERKGYAKAFQDIRKMNKDEKPSEYMSYIQSQLMLYQKKQEEKEKINHFEKFINQVFIKGFNSFIEKNRLTYICHPTKNTVPENDNIEIPFHTDMDDSNIAFWLMCKLLDAKQLSELRNEMIKFSCSLQSTEEISTFTKAREVIGLALLNGEKGCNDWKELFDDKEAWKKNMSLYVSEELLQSLPYTQEDGQTPVINRSIDLVKKYGTETILEKLFSSSDDYKVSAKDIAKLHEYDVTEKIAQQESLHKQWIEKPGLARDSAWTKKYQNVINDISNYQWAKTKVELTQVRHLHQLTIDLLSRLAGYMSIADRDFQFSSNYILERENSEYRVTSWILLSENKNKNKYNDYELYNLKNASIKVSSKNDPQLKVDLKQLRLTLEYLELFDNRLKEKRNNISHFNYLNGQLGNSILELFDDARDVLSYDRKLKNAVSKSLKEILSSHGMEVTFKPLYQTNHHLKIDKLQPKKIHHLGEKSTVSSNQVSNEYCQLVRTLLTMK

SEQ ID NO: 208 - protein, 1159 aa, Leptotrichia buccalis
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDRKLKNAVMKSVVDILKEYGFVATFKIGADKKIGIQTLESEKIVHLKNLKKKKLMTDRNSEELCKLVKIMFEYKMEEKKSEN

SEQ ID NO: 209 - protein, 1285 aa, Herbinix hemicellulosilytica
MKLTRRRISGNSVDQKITAAFYRDMSQGLLYYDSEDNDCTDKVIESMDFERSWRGRILKNGEDDKNPFYMFVKGLVGSNDKIVCEPIDVDSDPDNLDILINKNLTGFGRNLKAPDSNDTLENLIRKIQAGIPEEEVLPELKKIKEMIQKDIVNRKEQLLKSIKNNRIPFSLEGSKLVPSTKKMKWLFKLIDVPNKTFNEKMLEKYWEIYDYDKLKANITNRLDKTDKKARSISRAVSEELREYHKNLRTNYNRFVSGDRPAAGLDNGGSAKYNPDKEEFLLFLKEVEQYFKKYFPVKSKHSNKSKDKSLVDKYKNYCSYKVVKKEVNRSIINQLVAGLIQQGKLLYYFYYNDTWQEDFLNSYGLSYIQVEEAFKKSVMTSLSWGINRLTSFFIDDSNTVKFDDITTKKAKEAIESNYFNKLRTCSRMQDHFKEKLAFFYPVYVKDKKDRPDDDIENLIVLVKNAIESVSYLRNRTFHFKESSLLELLKELDDKNSGQNKIDYSVAAEFIKRDIENLYDVFREQIRSLGIAEYYKADMISDCFKTCGLEFALYSPKNSLMPAFKNVYKRGANLNKAYIRDKGPKETGDQGQNSYKALEEYRELTWYIEVKNNDQSYNAYKNLLQLIYYHAFLPEVRENEALITDFINRTKEWNRKETEERLNTKNNKKHKNFDENDDITVNTYRYESIPDYQGESLDDYLKVLQRKQMARAKEVNEKEEGNNNYIQFIRDVVVWAFGAYLENKLKNYKNELQPPLSKENIGLNDTLKELFPEEKVKSPFNIKCRFSISTFIDNKGKSTDNTSAEAVKTDGKEDEKDKKNIKRKDLLCFYLFLRLLDENEICKLQHQFIKYRCSLKERRFPGNRTKLEKETELLAELEELMELVRFTMPSIPEISAKAESGYDTMIKKYFKDFIEKKVFKNPKTSNLYYHSDSKTPVTRKYMALLMRSAPLHLYKDIFKGYYLITKKECLEYIKLSNIIKDYQNSLNELHEQLERIKLKSEKQNGKDSLYLDKKDFYKVKEYVENLEQVARYKHLQHKINFESLYRIFRIHVDIAARMVGYTQDWERDMHFLFKALVYNGVLEERRFEAIFNNNDDNNDGRIVKKIQNNLNNKNRELVSMLCWNKKLNKNEFGAIIWKRNPIAHLNHFTQTEQNSKSSLESLINSLRILLAYDRKRQNAVTKTINDLLLNDYHIRIKWEGRVDEGQIYFNIKEKEDIENEPIIHLKHLHKKDCYIYKNSYMFDKQKEWICNGIKEEVYDKSILKCIGNLFKFDYEDKNKSSANPKHT

SEQ ID NO: 210 - protein, 1344 aa, Eubacterium rectale
MLRRDKEVKKLYNVFNQIQVGTKPKKWNNDEKLSPEENERRAQQKNIKMKNYKWREACSKYVESSQRIINDVIFYSYRKAKNKLRYMRKNEDILKKMQEAEKLSKFSGGKLEDFVAYTLRKSLVVSKYDTQEFDSLAAMVVFLECIGKNNISDHEREIVCKLLELIRKDFSKLDPNVKGSQGANIVRSVRNQNMIVQPQGDRFLFPQVYAKENETVTNKNVEKEGLNEFLLNYANLDDEKRAESLRKLRRILDVYFSAPNHYEKDMDITLSDNIEKEKFNVWEKHECGKKETGLFVDIPDVLMEAEAENIKLDAVVEKRERKVLNDRVRKQNIICYRYTRAVVEKYNSNEPLFFENNAINQYWIHHIENAVERILKNCKAGKLFKLRKGYLAEKVWKDAINLISIKYIALGKAVYNFALDDIWKDKKNKELGIVDERIRNGITSFDYEMIKAHENLQRELAVDIAFSVNNLARAVCDMSNLGNKESDFLLWKRNDIADKLKNKDDMASVSAVLQFFGGKSSWDINIFKDAYKGKKKYNYEVRFIDDLRKAIYCARNENFHFKTALVNDEKWNTELFGKIFERETEFCLNVEKDRFYSNNLYMFYQVSELRNMLDHLYSRSVSRAAQVPSYNSVIVRTAFPEYITNVLGYQKPSYDADTLGKWYSACYYLLKEIYYNSFLQSDRALQLFEKSVKTLSWDDKKQQRAVDNFKDHFSDIKSACTSLAQVCQIYMTEYNQQNNQIKKVRSSNDSIFDQPVYQHYKVLLKKAIANAFADYLKNNKDLFGFIGKPFKANEIREIDKEQFLPDWTSRKYEALCIEVSGSQELQKWYIVGKFLNARSLNLMVGSMRSYIQYVTDIKRRAASIGNELHVSVHDVEKVEKWVQVIEVCSLLASRTSNQFEDYFNDKDDYARYLKSYVDFSNVDMPSEYSALVDFSNEEQSDLYVDPKNPKVNRNIVHSKLFAADHILRDIVEPVSKDNIEEFYSQKAEIAYCKIKGKEITAEEQKAVLKYQKLKNRVELRDIVEYGEIINELLGQLINWSFMRERDLLYFQLGFHYDCLRNDSKKPEGYKNIKVDENSIKDAILYQIIGMYVNGVTVYAPEKDGDKLKEQCVKGGVGVKVSAFHRYSKYLGLNEKTLYNAGLEIFEVVAEHEDIINLRNGIDHFKYYLGDYRSMLSIYSEVFDRFFTYDIKYQKNVLNLLQNILLRHNVIVEPILESGFKTIGEQTKPGAKLSIRSIKSDTFQYKVKGGTLITDAKDERYLETIRKILYYAENEEDNLKKSVVVTNADKYEKNKESDDQNKQKEKKNKDNKGKKNEETKSDAEKNNNERLSYNPFANLNFKLSN

SEQ ID NO: 211 - protein, 1373 aa, Eubacteriaceae bacterium
MKISKESHKRTAVAVMEDRVGGVVYVPGGSGIDLSNNLKKRSMDTKSLYNVFNQIQAGTAPSEYEWKDYLSEAENKKREAQKMIQKANYELRRECEDYAKKANLAVSRIIFSKKPKKIFSDDDIISHMKKQRLSKFKGRMEDFVLIALRKSLVVSTYNQEVFDSRKAATVFLKNIGKKNISADDERQIKQLMALIREDYDKWNPDKDSSDKKESSGTKVIRSIEHQNMVIQPEKNKLSLSKISNVGKKTKTKQKEKAGLDAFLKEYAQIDENSRMEYLKKLRRLLDTYFAAPSSYIKGAAVSLPENINFSSELNVWERHEAAKKVNINFVEIPESLLNAEQNNNKINKVEQEHSLEQLRTDIRRRNITCYHFANALAADERYHTLFFENMAMNQFWIHHMENAVERILKKCNVGTLFKLRIGYLSEKVWKDMLNLLSIKYIALGKAVYHFALDDIWKADIWKDASDKNSGKINDLTLKGISSFDYEMVKAQEDLQREMAVGVAFSTNNLARVTCKMDDLSDAESDFLLWNKEAIRRHVKYTEKGEILSAILQFFGGRSLWDESLFEKAYSDSNYELKFLDDLKRAIYAARNETFHFKTAAIDGGSWNTRLFGSLFEKEAGLCLNVEKNKFYSNNLVLFYKQEDLRVFLDKLYGKECSRAAQIPSYNTILPRKSFSDFMKQLLGLKEPVYGSAILDQWYSACYYLFKEVYYNLFLQDSSAKALFEKAVKALKGADKKQEKAVESFRKRYWEISKNASLAEICQSYITEYNQQNNKERKVRSANDGMFNEPIYQHYKMLLKEALKMAFASYIKNDKELKFVYKPTEKLFEVSQDNFLPNWNSEKYNTLISEVKNSPDLQKWYIVGKFMNARMLNLLLGSMRSYLQYVSDIQKRAAGLGENQLHLSAENVGQVKKWIQVLEVCLLLSVRISDKFTDYFKDEEEYASYLKEYVDFEDSAMPSDYSALLAFSNEGKIDLYVDASNPKVNRNIIQAKLYAPDMVLKKVVKKISQDECKEFNEKKEQIMQFKNKGDEVSWEEQQKILEYQKLKNRVELRDLSEYGELINELLGQLINWSYLRERDLLYFQLGFHYSCLMNESKKPDAYKTIRRGTVSIENAVLYQIIAMYINGFPVYAPEKGELKPQCKTGSAGQKIRAFCQWASMVEKKKYELYNAGLELFEVVKEHDNIIDLRNKIDHFKYYQGNDSILALYGEIFDRFFTYDMKYRNNVLNHLQNILLRHNVIIKPIISKDKKEVGRGKMKDRAAFLLEEVSSDRFTYKVKEGERKIDAKNRLYLETVRDILYFPNRAVNDKGEDVIICSKKAQDLNEKKADRDKNHDKSKDTNQKKEGKNQEEKSENKEPYSDRMTWKPFAGIKLE

SEQ ID NO: 212 - protein, 1276 aa, unidentified
MKISKVDHVKSGIDQKLSSQRGMLYKQPQKKYEGKQLEEHVRNLSRKAKALYQVFPVSGNSKMEKELQIINSFIKNILLRLDSGKTSEEIVGYINTYSVASQISGDHIQELVDQHLKESLRKYTCVGDKRIYVPDIIVALLKSKFNSETLQYDNSELKILIDFIREDYLKEKQIKQIVHSIENNSTPLRIAEINGQKRLIPANVDNPKKSYIFEFLKEYAQSDPKGQESLLQHMRYLILLYLYGPDKITDDYCEEIEAWNFGSIVMDNEQLFSEEASMLIQDRIYVNQQIEEGRQSKDTAKVKKNKSKYRMLGDKIEHSINESVVKHYQEACKAVEEKDIPWIKYISDHVMSVYSSKNRVDLDKLSLPYLAKNTWNTWISFIAMKYVDMGKGVYHFAMSDVDKVGKQDNLIIGQIDPKFSDGISSFDYERIKAEDDLHRSMSGYIAFAVNNFARAICSDEFRKKNRKEDVLTVGLDEIPLYDNVKRKLLQYFGGASNWDDSIIDIIDDKDLVACIKENLYVARNVNFHFAGSEKVQKKQDDILEEIVRKETRDIGKHYRKVFYSNNVAVFYCDEDIIKLMNHLYQREKPYQAQIPSYNKVISKTYLPDLIFMLLKGKNRTKISDPSIMNMFRGTFYFLLKEIYYNDFLQASNLKEMFCEGLKNNVKNKKSEKPYQNFMRRFEELENMGMDFGEICQQIMTDYEQQNKQKKKTATAVMSEKDKKIRTLDNDTQKYKHFRTLLYIGLREAFIIYLKDEKNKEWYEFLREPVKREQPEEKEFVNKWKLNQYSDCSELILKDSLAAAWYVVAHFINQAQLNHLIGDIKNYIQFISDIDRRAKSTGNPVSESTEIQIERYRKILRVLEFAKFFCGQITNVLTDYYQDENDFSTHVGHYVKFEKKNMEPAHALQAFSNSLYACGKEKKKAGFYYDGMNPIVNRNITLASMYGNKKLLENAMNPVTEQDIRKYYSLMAELDSVLKNGAVCKSEDEQKNLRHFQNLKNRIELVDVLTLSELVNDLVAQLIGWVYIRERDMMYLQLGLHYIKLYFTDSVAEDSYLRTLDLEEGSIADGAVLYQIASLYSFNLPMYVKPNKSSVYCKKHVNSVATKFDIFEKEYCNGDETVIENGLRLFENINLHKDMVKFRDYLAHFKYFAKLDESILELYSKAYDFFFSYNIKLKKSVSYVLTNVLLSYFINAKLSFSTYKSSGNKTVQHRTTKISVVAQTDYFTYKLRSIVKNKNGVESIENDDRRCEVVNIAARDKEFVDEVCNVINYNSDK

SEQ ID NO: 213 - protein, 1385 aa, unidentified
MGNLFGHKRWYEVRDKKDFKIKRKVKVKRNYDGNKYILNINENNNKEKIDNNKFIGEFVNYKKNNNVLKEFKRKFHAGNILFKLKGKEEIIRIENNDDFLETEEVVLYIEVYGKSEKLKALEITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDNKIDVILTNFMEIREKIKSNLEIMGFVKFYLNVSGDKKKSENKKMFVEKILNTNVDLTVEDIVDFIVKELKFWNITKRIEKVKKFNNEFLENRRNRTYIKSYVLLDKHEKFKIERENKKDKIVKFFVENIKNNSIKEKIEKILAEFKINELIKKLEKELKKGNCDTEIFGIFKKHYKVNFDSKKFSNKSDEEKELYKIIYRYLKGRIEKILVNEQKVRLKKMEKIEIEKILNESILSEKILKRVKQYTLEHIMYLGKLRHNDIVKMTVNTDDFSRLHAKEELDLELITFFASTNMELNKIFNGKEKVTDFFGFNLNGQKITLKEKVPSFKLNILKKLNFINNENNIDEKLSHFYSFQKEGYLLRNKILHNSYGNIQETKNLKGEYENVEKLIKELKVSDEEISKSLSLDVIFEGKVDIINKINSLKIGEYKDKKYLPSFSKIVLEITRKFREINKDKLFDIESEKIILNAVKYVNKILYEKITSNEENEFLKTLPDKLVKKSNNKKENKNLLSIEEYYKNAQVSSSKGDKKAIKKYQNKVTNAYLEYLENTFTEIIDFSKFNLNYDEIKTKIEERKDNKSKIIIDSISTNINITNDIEYIISIFALLNSNTYINKIRNRFFATSVWLEKQNGTKEYDYENIISILDEVLLINLLRENNITDILDLKNAIIDAKIVENDETYIKNYIFESNEEKLKKRLFCEELVDKEDIRKIFEDENFKFKSFIKKNEIGNFKINFGILSNLECNSEVEAKKIIGKNSKKLESFIQNIIDEYKSNIRTLFSSEFLEKYKEEIDNLVEDTESENKNKFEKIYYPKEHKNELYIYKKNLFLNIGNPNFDKIYGLISKDIKNVDTKILFDDDIKKNKISEIDAILKNLNDKLNGYSNDYKAKYVNKLKENDDFFAKNIQNENYSSFGEFEKDYNKVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFRLIGNNDILERLMKPKKVSVLELESYNSDYIKNLIIELLTKIENTNDTL

SEQ ID NO: 214 - protein, 1334 aa, Lachnospiraceae bacterium
MKISKVDHTRMAVAKGNQHRRDEISGILYKDPTKTGSIDFDERFKKLNCSAKILYHVFNGIAEGSNKYKNIVDKVNNNLDRVLFTGKSYDRKSIIDIDTVLRNVEKINAFDRISTEEREQIIDDLLEIQLRKGLRKGKAGLREVLLIGAGVIVRTDKKQEIADFLEILDEDFNKTNQAKNIKLSIENQGLVVSPVSRGEERIFDVSGAQKGKSSKKAQEKEALSAFLLDYADLDKNVRFEYLRKIRRLINLYFYVKNDDVMSLTEIPAEVNLEKDFDIWRDHEQRKEENGDFVGCPDILLADRDVKKSNSKQVKIAERQLRESIREKNIKRYRFSIKTIEKDDGTYFFANKQISVFWIHRIENAVERILGSINDKKLYRLRLGYLGEKVWKDILNFLSIKYIAVGKAVFNFAMDDLQEKDRDIEPGKISENAVNGLTSFDYEQIKADEMLQREVAVNVAFAANNLARVTVDIPQNGEKEDILLWNKSDIKKYKKNSKKGILKSILQFFGGASTWNMKMFEIAYHDQPGDYEENYLYDIIQIIYSLRNKSFHFKTYDHGDKNWNRELIGKMIEHDAERVISVEREKFHSNNLPMFYKDADLKKILDLLYSDYAGRASQVPAFNTVLVRKNFPEFLRKDMGYKVHFNNPEVENQWHSAVYYLYKEIYYNLFLRDKEVKNLFYTSLKNIRSEVSDKKQKLASDDFASRCEEIEDRSLPEICQIIMTEYNAQNFGNRKVKSQRVIEKNKDIFRHYKMLLIKTLAGAFSLYLKQERFAFIGKATPIPYETTDVKNFLPEWKSGMYASFVEEIKNNLDLQEWYIVGRFLNGRMLNQLAGSLRSYIQYAEDIERRAAENRNKLFSKPDEKIEACKKAVRVLDLCIKISTRISAEFTDYFDSEDDYADYLEKYLKYQDDAIKELSGSSYAALDHFCNKDDLKFDIYVNAGQKPILQRNIVMAKLFGPDNILSEVMEKVTESAIREYYDYLKKVSGYRVRGKCSTEKEQEDLLKFQRLKNAVEFRDVTEYAEVINELLGQLISWSYLRERDLLYFQLGFHYMCLKNKSFKPAEYVDIRRNNGTIIHNAILYQIVSMYINGLDFYSCDKEGKTLKPIETGKGVGSKIGQFIKYSQYLYNDPSYKLEIYNAGLEVFENIDEHDNITDLRKYVDHFKYYAYGNKMSLLDLYSEFFDRFFTYDMKYQKNVVNVLENILLRHFVIFYPKFGSGKKDVGIRDCKKERAQIEISEQSLTSEDFMFKLDDKAGEEAKKFPARDERYLQTIAKLLYYPNEIEDMNRFMKKGETINKKVQFNRKKKITRKQKNNSSNEVLSSTMGYLFKNIKL

SEQ ID NO: 215 - protein, 500 aa, Chloroflexus aggregans
MTDQVRREEVAAGELADTPLAAAQTPAADAAVAATPAPAEAVAPTPEQAVDQPATTGESEAPVTTAQAAAHEAEPAEATGASFTPVSEQQPQKPRRLKDLQPGMELEGKVTSIALYGIFVDVGVGRDGLVHISEMSDRRIDTPSELVQIGDTVKVWVKSVDLDARRISLTMLNPSRGEKPRRSRQSQPAQPQPRRQEVDREKLASLKVGEIVEGVITGFAPFGAFADIGVGKDGLIHISELSEGRVEKPEDAVKVGERYQFKVLEIDGEGTRISLSLRRAQRTQRMQQLEPGQIIEGTVSGIATFGAFVDIGVGRDGLVHISALAPHRVAKVEDVVKVGDKVKVKVLGVDPQSKRISLTMRLEEEQPATTAGDEAAEPAEEVTPTRRGNLERFAAAAQTARERSERGERSERGERRERRERRPAQSSPDTYIVGEDDDESFEGNATIEDLLTKFGGSSSRRDRDRRRRHEDDDDEEMERPSNRRQREAIRRTLQQIGYDE

SEQ ID NO: 216 - protein, 249 aa, Demequina aurantiaca
MDLTWHALLILFIVALLAGFLDTLAGGGGLLTVPALLLTGIPPLQALGTNKLQSSFGTGMATYQVIRKKRVHWRDVRWPMVWAFLGSAAGAVAVQFIDTDALLIIIPVVLALVAAYFLFVPKSHLPPPEPRMSDPAYEATLVPIIGAYDGAFGPGTGSLYALSGVALRAKTLVQSTAIAKTLNFATNFAALLVFAFAGHMLWTVGAVMIAGQLIGAYAGSHMLFRVNPLVLRVLIVVMSLGMLIRVLLD

SEQ ID NO: 217 - protein, 1235 aa, unidentified
MRIIKPYGRSHVEGVATQEPRRKLRLNSSPDISRDIPGFAQSHDALIIAQWISAIDKIATKPKPDKKPTQAQINLRTTLGDAAWQHVMAENLLPAATDPAIREKLHLIWQSKIAPWGTARPQAEKDGKPTPKGGWYERFCGVLSPEAITQNVARQIAKDIYDHLHVAAKRKGREPAKQGESSNKPGKFKPDRKRGLIEERAESIAKNALRPGSHAPCPWGPDDQATYEQAGDVAGQIYAAARDCLEEKKRRSGNRNTSSVQYLPRDLAAKILYAQYGRVFGPDTTIKAALDEQPSLFALHKAIKDCYHRLINDARKRDILRILPRNMAALFRLVRAQYDNRDINALIRLGKVIHYHASEQGKSEHHGIRDYWPSQQDIQNSRFWGSDGQADIKRHEAFSRIWRHIIALASRTLHDWADPHSQKFSGENDDILLLAKDAIEDDVFKAGHYERKCDVLFGAQASLFCGAEDFEKAILKQAITGTGNLRNATFHFKGKVRFEKELQELTKDVPVEVQSAIAALWQKDAEGRTRQIAETLQAVLAGHFLTEEQNRHIFAALTAAMAQPGDVPLPRLRRVLARHDSICQRGRILPLSPCPDRAKLEESPALTCQYTVLKMLYDGPFRAWLAQQNSTILNHYIDSTIARTDKAARDMNGRKLAQAEKDLITSRAADLPRLSVDEKMGDFLARLTAATATEMRVQRGYQSDGENAQKQAAFIGQFECDVIGRAFADFLNQSGFDFVLKLKADTPQPDAAQCDVTALIAPDDISVSPPQAWQQVLYFILHLVPVDDASHLLHQIRKWQVLEGKEKPAQIAHDVQSVLMLYLDMHDAKFTGGAALHGIEKFAEFFAHAADFRAVFPPQSLQDQDRSIPRRGLREIVRFGHLPLLQHMSGTVQITHDNVVAWQAARTAGATGMSPIARRQKQREELHALAVERTARFRNADLQNYMHALVDVIKHRQLSAQVTLSDQVRLHRLMMGVLGRLVDYAGLWERDLYFVVLALLYHHGATPDDVFKGQGKKNLADGQVVAALKPKNRKAAAPVGVFDDLDHYGIYQDDRQSIRNGLSHFNMLRGGKAPDLSHWVNQTRSLVAHDRKLKNAVAKSVIEMLAREGFDLDWGIQTDRGQHILSHGKIRTRQAQHFQKSRLHIVKKSAKPDKNDTVKIRENLHGDAMVERVVQLFAAQVQKRYDITVEKRLDHLFLKPQDQKGKNGIHTHNGWSKTEKKRRPSRENRKGNHEN

SEQ ID NO: 218 - protein, 1312 aa, unidentified
MKFSKESHRKTAVGVTESNGIIGLLYKDPLNEKEKIEDVVNQRANSTKRLFNLFGTEATSKDISRASKDLAKVVNKAIGNLKGNKKFNKKEQITKGLNTKIIVEELKNVLKDEKKLIVNKDIIDEACSRLLKTSFRTAKTKQAVKMILTAVLIENTNLSKEDEAFVHEYFVKKLVNEYNKTSVKKQIPVALSNQNMVIQPNSVNGTLEISETKKSKETKTTEKDAFRAFLRDYATLDENRRHKMRLCLRNLVNLYFYGETSVSKDDFDEWRDHEDKKQNDELFVKKIVSIKTDRKGNVKEVLDVDATIDAIRTNNIACYRRALAYANENPDVFFSDTMLNKFWIHHVENEVERIYGHINNNTGDYKYQLGYLSEKVWKGIINYLSIKYIAEGKAVYNYAMNALAKDNNSNAFGKLDEKFVNGITSFEYERIKAEETLQRECAVNIAFAANHLANATVDLNEKDSDFLLLKHEDNKDTLGAVARPNILRNILQFFGGKSRWNDFDFSGIDEIQLLDDLRKMIYSLRNSSFHFKTENIDNDSWNTKLIGDMFAYDFNMAGNVQKDKMYSNNVPMFYSTSDIEKMLDRLYAEVHERASQVPSFNSVFVRKNFPDYLKNDLKITSAFGVDDALKWQSAVYYVCKEIYYNDFLQNPETFTMLKDYVQCLPIDIDKSMDQKLKSERNAHKNFKEAFATYCKECDSLSAICQMIMTEYNNQNKGNRKVISARTKDGDKLIYKHYKMILFEALKNVFTIYLEKNINTYGFLKKPKLINNVPAIEEFLPNYNGRQYETLVNRITEETELQKWYIVGRLLNPKQVNQLIGNFRSYVQYVNDVARRAKQTGNNLSNDNIAWDVKNIIQIFDVCTKLNGVTSNILEDYFDDGDDYARYLKNFVDYTNKNNDHSATLLGDFCAKEIDGIKIGIYHDGTNPIVNRNIIQCKLYGATGIISDLTKDGSILSVDYEIIKKYMQMQKEIKVYQQKGICKTKEEQQNLKKYQELKNIVELRNIIDYSEILDELQGQLINWGYLRERDLMYFQLGFHYLCLHNESKKPVGYNNAGDISGAVLYQIVAMYTNGLSLIDANGKSKKNAKASAGAKVGSFCSYSKEIRGVDKDTKEDDDPIYLAGVELFENINEHQQCINLRNYIEHFHYYAKHDRSMLDLYSEVFDRFFTYDMKYTKNVPNMMYNILLQHLVVPAFEFGSSEKRLDDNDEQTKPRAMFTLREKNGLSSEQFTYRLGDGNSTVKLSARGDDYLRAVASLLYYPDRAPEGLIRDAEAEDKFAKINHSNPKSDNRNNRGNFKNPKVQWYNNKTKRK

SEQ ID NO: 219 - protein, 1343 aa, unidentified
MKISKVDHRKTAVKITDNKGAEGFIYQDPTRDSSTMEQIISNRARSSKVLFNIFGDTKKSKDLNKYTESLIIYVNKAIKSLKGDKRNNKYEEITESLKTERVLNALIQAGNEFTCSENNIEDALNKYLKKSFRVGNTKSALKKLLMAAYCGYKLSIEEKEEIQNYFVDKLVKEYNKDTVLKYTAKSLKHQNMVVQPDTDNHVFLPSRIAGATQNKMSEKEALTEFLKAYAVLDEEKRHNLRIILRKLVNLYFYESPDFIYPENNEWKEHDDRKNKTETFVSPVKVNEEKNGKTFVKIDVPATKDLIRLKNIECYRRSVAETAGNPITYFTDHNISKFWIHHIENEVEKIFALLKSNWKDYQFSVGYISEKVWKEIINYLSIKYIAIGKAVYNYALEDIKKNDGTLNFGVIDPSFYDGINSFEYEKIKAEETFQREVAVYVSFAVNHLSSATVKLSEAQSDMLVLNKNDIEKIAYGNTKRNILQFFGGQSKWKEFDFDRYINPVNYTDIDFLFDIKKMVYSLRNESFHFTTTDTESDWNKNLISAMFEYECRRISTVQKNKFFSNNLPLFYGENSLERVLHKLYDDYVDRMSQVPSFGNVFVRKKFPDYMKEIGIKHNLSSEDNLKLQGALYFLYKEIYYNAFISSEKAMKIFVDLVNKLDTNARDDKGRITHEAMAHKNFKDAISHYMTHDCSLADICQKIMTEYNQQNTGHRKKQTTYSSEKNPEIFRHYKMILFMLLQKAMTEYISSEEIFDFIMKPNSPKTDIKEEEFLPQYKSCAYDNLIKLIADNVELQKWYITARLLSPREVNQLIGSFRSYKQFVSDIERRAKETNNSLSKSGMTVDVENITKVLDLCTKLNGRFSNELTDYFDSKDDYAVYVSKFLDFGFKIDEKFPAALLGEFCNKEENGKKIGIYHNGTEPILNSNIIKSKLYGITDVVSRAVKPVSEKLIREYLQQEVKIKPYLENGVCKNKEEQAALRKYQELKNRIEFRDIVEYSEIINELMGQLINFSYLRERDLMYFQLGFHYLCLNNYGAKPEGYYSIVNDKRTIKGAILYQIVAMYTYGLPIYHYVDGTISDRRKNKKTVLDTLNSSETVGAKIKYFIYYSDELFNDSLILYNAGLELFENINEHENIVNLRKYIDHFKYYVSQDRSLLDIYSEVFDRYFTYDRKYKKNVMNLFSNIMLKHFIITDFEFSTGEKTIGEKNTAKKECAKVRIKRGGLSSDKFTYKFKDAKPIELSAKNTEFLDGVARILYYPENVVLTDLVRNSEVEDEKRIEKYDRNHNSSPTRKDKTYKQDVKKNYNKKTSKAFDSSKLDTKSVGNNLSDNPVLKQFLSESKKKR

SEQ ID NO: 220 - protein, 1276 aa, unidentified; identical to SEQ ID NO: 212

SEQ ID NO: 221 - protein, 1168 aa, unidentified
MKITKIDGISHKKYIKEGKLVKSTSEENKTDERLSELLTIRLDTYIKNPDNASEEENRIRRENLKEFFSNKVLYLKDGILYLKDRREKNQLQNKNYSEEDISEYDLKNKNNFLVLKKILLNEDINSEELEIFRNDFEKKLDKINSLKYSLEENKANYQKINENNIKKVEGKSKRNIFYNYYKDSAKRNDYINNIQEAFDKLYKKEDIENLFFLIENSKKHEKYKIRECYHKIIGRKNDKENFATIIYEEIQNVNNMKELIEKVPNVSELKKSQVFYKYYLNKEKLNDENIKYVFCHFVEIEMSKLLKNYVYKKPSNISNDKVKRIFEYQSLKKLIENKLLNKLDTYVRNCGKYSFYLQDGEIATSDFIVGNRQNEAFLRNIIGVSSTAYFSLRNILETENENDITGRMRGKTVKNNKGEEKYISGEIDKLYDNNKQNEVKKNLKMFYSYDFNMNSKKEIEDFFSNIDEAISSIRHGIVHFNLELEGKDIFTFKNIVPSQISKKMFHDEINEKKLKLKIFKQLNSANVFRYLEKYKILNYLNRTRFEFVNKNIPFVPSFTKLYSRIDDLKNSLGIYWKTPKTNDDNKTKEITDAQIYLLKNIYYGEFLNYFMSNNGNFFEITKEIIELNKNDKRNLKTGFYKLQKFENLQEKTPKEYLANIQSLYMINAGNQDEEEKDTYIDFIQKIFLKGFMTYLANNGRLSLIYIGSDEETNTSLAEKKQEFDKFLKKYEQNNNIEIPYEINEFVREIKLGKILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKISDEAKYKISIEELKNYSKKKNEIEENHTTQENLHRKYARPRKDEKFTDEDYKKYEKAIRNIQQYTHLKNKVEFNELNLLQSLLLRILHRLVGYTSIWERDLRFRLKGEFPENQYIEEIFNFDNSKNVKYKNGQIVEKYINFYKELYKDDTEKISIYSDKKVKELKKEKKDLYIRNYIAHFNYIPNAEISLLEMLENLRKLLSYDRKLKNAIMKSIVDILKEYGFVVTFKIEKDKKIRIESLKSEEVVHLKKLKLKDNDKKKEPIKTYRNSKELCKLVKVMFEYKMKEKKSEN

SEQ ID NO: 222 - protein, 1138 aa, Bacteroides ihuae
MRITKVKVKESSDQKDKMVLIHRKVGEGTLVLDENLADLTAPIIDKYKDKSFELSLLKQTLVSEKEMNIPKCDKCTAKERCLSCKQREKRLKEVRGAIEKTIGAVIAGRDIIPRLNIFNEDEICWLIKPKLRNEFTFKDVNKQVVKLNLPKVLVEYSKKNDPTLFLAYQQWIAAYLKNKKGHIKKSILNNRVVIDYSDESKLSKRKQALELWGEEYETNQRIALESYHTSYNIGELVTLLPNPEEYVSDKGEIRPAFHYKLKNVLQMHQSTVFGTNEILCINPIFNENRANIQLSAYNLEVVKYFEHYFPIKKKKKNLSLNQAIYYLKVETLKERLSLQLENALRMNLLQKGKIKKHEFDKNTCSNTLSQIKRDEFFVLNLVEMCAFAANNIRNIVDKEQVNEILSKKDLCNSLSKNTIDKELCTKFYGADFSQIPVAIWAMRGSVQQIRNEIVHYKAEAIDKIFALKTFEYDDMEKDYSDTPFKQYLELSIEKIDSFFIEQLSSNDVLNYYCTEDVNKLLNKCKLSLRRTSIPFAPGFKTIYELGCHLQDSSNTYRIGHYLMLIGGRVANSTVTKASKAYPAYRFMLKLIYNHLFLNKFLDNHNKRFFMKAVAFVLKDNRENARNKFQYAFKEIRMMNNDESIASYMSYIHSLSVQEQEKKGDKNDKVRYNTEKFIEKVFVKGFDDFLSWLGVEFILSPNQEERDKTVTREEYENLMIKDRVEHSINSNQESHIAFFTFCKLLDANHLSDLRNEWIKFRSSGDKEGFSYNFAIDIIELCLLTVDRVEQRRDGYKEQTELKEYLSFFIKGNESENTVWKGFYFQQDNYTPVLYSPIELIRKYGTLELLKLIIVDEDKITQGEFEEWQTLKKVVEDKVTRRNELHQEWEDMKNKSSFSQEKCSIYQKLCRDIDRYNWLDNKLHLVHLRKLHNLVIQILSRMARFIALWDRDFVLLDASRANDDYKLLSFFNFRDFINAKKTKTDDELLAEFGSKIEKKNAPFIKAEDVPLMVECIEAKRSFYQKVFFRNNLQVLADRNFIAHYNYISKTAKCSLFEMIIKLRTLMYYDRKLRNAVVKSIANVFDQNGMVLQLSLDDSHELKVDKVISKRIVHLKNNNIMTDQVPEEYYKICRRLLEMKK

SEQ ID NO: 223 - protein, 697 aa, Porphyromonadaceae bacterium
MEFRDSIFKSLLQKEIEKAPLCFAEKLISGGVFSYYPSERLKEFVGNHPFSLFRKTMPFSPGFKRVMKSGGNYQNANRDGRFYDLDIGVYLPKDGFGDEEWNARYFLMKLIYNQLFLPYFADAENHLFRECVDFVKRVNRDYNCKNNNSEEQAFIDIRSMREDESIADYLAFIQSNIIIEENKKKETNKEGQINFNKFLLQVFVKGFDSFLKDRTELNFLQLPELQGDGTRGDDLESLDKLGAVVAVDLKLDATGIDADLNENISFYTFCKLLDSNHLSRLRNEIIKYQSANSDFSHNEDFDYDRIISIIELCMLSADHVSTNDNESIFPNNDKDFSGIRPYLSTDAKVETFEDLYVHSDAKTPITNATMVLNWKYGTDKLFERLMISDQDFLVTEKDYFVWKELKKDIEEKIKLREELHSLWVNTPKGKKGAKKKNGRETTGEFSEENKKEYLEVCREIDRYVNLDNKLHFVHLKRMHSLLIELLGRFVGFTYLFERDYQYYHLEIRSRRNKDAGVVDKLEYNKIKDQNKYDKDDFFACTFLYEKANKVRNFIAHFNYLTMWNSPQEEEHNSNLSGAKNSSGRQNLKCSLTELINELREVMSYDRKLKNAVTKAVIDLFDKHGMVIKFRIVNNNNNDNKNKHHLELDDIVPKKIMHLRGIKLKRQDGKPIPIQTDSVDPLYCRMWKKLLDLKPTPF

SEQ ID NO: 224 - protein, 204 aa, Listeria riparia
MHDAWAENPKKPQSDAFLKEYKACCEAIDTYNWHKNKATLVYVNELHHLLIDILGRLVGYVAIADRDFQCMANQYLKSSGHTERVDSWINTIRKNRPDYIEKLDIFMNKAGLFVSEKNGRNYIAHLNYLSPKHKYSLLYLFEKLREMLKYDRKLKNAVTKSLIDLLDKHGMCVVFANLKNNKHRLVIASLKPKKIETFKWKKIK

SEQ ID NO: 225 - protein, 1082 aa, Insolitispirillum peregrinum
MRIIRPYGSSTVASPSPQDAQPLRSLQRQNGTFDVAEFSRRHPELVLAQWVAMLDKIIRKPAPGKNSTALPRPTAEQRRLRQQVGAALWAEMQRHTPVPPELKAVWDSKVHPYSKDNAPATAKTPSHRGRWYDRFGDPETSAATVAEGVRRHLLDSAQPFRANGGQPKGKGVIEHRALTIQNGTLLHHHQSEKAGPLPEDWSTYRADELVSTIGKDARWIKVAASLYQHYGRIFGPTTPISEAQTRPEFVLHTAVKAYYRRLFKERKLPAERLERLLPRTGEALRHAVTVQHGNRSLADAVRIGKILHYGWLQNGEPDPWPDDAALYSSRYWGSDGQTDIKHSEAVSRVWRRALTAAQRTLTSWLYPAGTDAGDILLIGQKPDSIDRNRLPLLYGDSTRHWTRSPGDVWLFLKQTLENLRNSSFHFKTLSAFTSHLDGTCESEPAEQQAAQALWQDDRQQDHQQVFLSLRALDATTYLPTGPLHRIVNAVQSTDATLPLPRFRRVVTRAANTRLKGFPVEPVNRRTMEDDPLLRCRYGVLKLLYERGFRAWLETRPSIASCLDQSLKRSTKAAQTINGKNSPQGVEILSRATKLLQAEGGGGHGIHDLFDRLYAATAREMRVQVGYHHDAEAARQQAEFIEDLKCEVVARAFCAYLKTLGIQGDTFRRQPEPLPTWPDLPDLPSSTIGTAQAALYSVLHLMPVEDVGSLLHQLRRWLVALQARGGEDGTAITATIPLLELYLNRHDAKFSGGGAGTGLRWDDWQVFFDCQATFDRVFPPGPALDSHRLPLRGLREVLRFGRVNDLAALIGQDKITAAEVDRWHTAEQTIAAQQQRREALHEQLSRKKGTDAEVDEYRALVTAIADHRHLTAHVTLSNVVRLHRLMTTVLGRLVDYGGLWERDLTFVTLYEAHRLGGLRNLLSESRVNKFLDGQTPAALSKKNNAEENGMISKVLGDKARRQIRNDFAHFNMLQQGKKTINLTDEINNARKLMAHDRKLKNAITRSVTTLLQQDGLDIVWTMDASHRLTDAKIDSRNAIHLHKTHNRANIREPLHGKSYCRWVAALFGATSTPSATKKSDKIR

SEQ ID NO: 226 - protein, 1115 aa, Fusobacterium necrophorum
MEKFRRQNRNSIIKIIISNYDTKGIKELKVRYRKQAQLDTFIIKTEIVNNDIFIKSIIEKAREKYRYSFLFDGEEKYHFKNKSSVEIVKKDIFSQTPDNMIRNYKITLKISEKNPRVVEAEIEDLMNSTILKDGRRSARREKSMTERKLIEEKVAKNYSLLANCPMEEVDSIKIYKIKRFLTYRSNMLLYFASINSFLCEGIKGKDNETEEIWHLKDNDVRKEKVRENFKNKLIQSTENYNSSLKNQIEEKEKLLRKEFKKGAFYRTIIKKLQQERIKELSEKSLTEDCEKIIKLYSKLRHSLMHYDYQYFENLFENKKNDDLMKDLNLDLFKSLPLIRKMKLNNKVNYLEDGDTLFVLQKTKKAKTLYQIYDALCEQKNGFNKFINDFFVSDGEENTVFKQIINEKFQSEMEFLEKRISESEKKNEKLKKKLDSMKAHFRNINSEDTKEAYFWDIHSSRNYKTKYNERKNLVNEYTELLGSSKEKKLLREEITKINRQLLKLKQEMEEITKKNSLFRLEYKMKIAFGFLFCEFDGNISKFKDEFDASNQEKIIQYHKNGEKYLTSFLKEEEKEKFNLEKMQKIIQKTEEEDWLLPETKNNLFKFYLLTYLLLPYELKGDFLGFVKKHYYDIKNVDFIDENQNNIQVSQTVEKQEDYFYHKIRLFEKNTKKYEIVKYSIVPNEKLKQYFEDLGIDIKYLTVEQKSEVSEEKNKKVSLKNNGMFNKTILLFVFKYYQIAFKLFNDIELYSLFFLREKSGKPLEIFRKELESKMKDGYLNFGQLLYVVYEVLVKNKDLDKILSKKIDYRKDKSFSPEIAYLRNFLSHLNYSKFLDNFMKINTNKSDENKEVLIPSIKIQKMIQFIEKCNLQNQIDFDFNFVNDFYMRKEKMFFIQLKQIFPDINSTEKQKMNEKEEILRNRYHLTDKKNEQIKDEHEAQSQLYEKILSLQKIYSSDKNNFYGRLKEEKLLFLEKQGKKKLSMEEIKDKIAGDISDLLGILKKEITRDIKDKLTEKFRYCEEKLLNLSFYNHQDKKKEESIRVFLIRDKNSDNFKFESILDDGSNKIFISKNGKEITIQCCDKVLETLIIEKNTLKISSNGKIISLIPHYSYSIDVKY

SEQ ID NO: 227 - protein, 1111 aa, Fusobacterium necrophorum
MEKFRRQNRSSIIKIIISNYDTKGIKELKVRYRKQAQLDTFIIKTEIVNNDIFIKSIIEKAREKYRYSFLFDGEEKYHFKNKSSVEIVKKDIFSQTPDNMIRNYKITLKISEKNPRVVEAEIEDLMNSTILKDGRRSARREKSMTERKLIEEKVAENYSLLANCPMEEVDSIKIYKIKRFLTYRSNMLLYFASINSFLCEGIKGKDNETEEIWHLKDNDVRKEKVKENFKNKLIQSTENYNSSLKNQIEEKEKLLRKESKKGAFYRTIIKKLQQERIKELSEKSLTEDCEKIIKLYSELRHPLMHYDYQYFENLFENKENSELTKNLNLDIFKSLPLVRKMKLNNKVNYLEDNDTLFVLQKTKKAKTLYQIYDALCEQKNGFNKFINDFFVSDGEENTVFKQIINEKFQSEIEFLEKRISESEKKNEKLKKKLDSMKAHFRNINSEDTKEAYFWDIHSSRNYKTKYNERKNLVNEYTELLGSSKEKKLLREEITKINRQLLKLKQEMEEITKKNSLFRLEYKMKMAFGFLFCEFDGNISRFKDEFDASNQEKIIQYHKNGEKYLTYFLKEEEKEKFNLKKLQETIQKTGEENWLLPQNKNNLFKFYLLTYLLLPYELKGDFLGFVKKHYYDIKNVDFMDENQSSKIIESKEDDFYHKIRLFEKNTKKYEIVKYSIVPDKKLKQYFKDLGIDTKYLILDQKSEVSGEKNKKVSLKNNGMFNKTILLFVFKYYQIAFKLFNDIELYSLFFLREKSGKPFEVFLKELKDKMIGKQLNFGQLLYVVYEVLVKNKDLSEILSERIDYRKDMCFSAEIADLRNFLSHLNYSKFLDNFMKINTNKSDENKEVLIPSIKIQKMIKFIEECNLQSQIDFDFNFVNDFYMRKEKMFFIQLKQIFPDINSTEKQKMNEKEEILRNRYHLTDKKNEQIKDEHEAQSQLYEKILSLQKIYSSDKNNFYGRLKEEKLLFLEKQEKKKLSMEEIKDKIAGDISDLLGILKKEITRDIKDKLTEKFRYCEEKLLNLSFYNHQDKKKEESIRVFLIRDKNSDNFKFESILDDGSNKIFISKNGKEITIQCCDKVLETLIIEKNTLKISSNGKIISLIPHYSYSIDVKY

SEQ ID NO: 228 - protein, 1110 aa, Fusobacterium necrophorum
MKVRYRKQAQLDTFIIKTEIVNNDIFIKSIIEKAREKYRYSFLFDGEEKYHFKNKSSVEIVKNDIFSQTPDNMIRNYKITLKISEKNPRVVEAEIEDLMNSTILKDGRRSARREKSMTERKLIEEKVAENYSLLANCPIEEVDSIKIYKIKRFLTYRSNMLLYFASINSFLCEGIKGKDNETEEIWHLKDNDVRKEKVKENFKNKLIQSTENYNSSLKNQIEEKEKLSSKEFKKGAFYRTIIKKLQQERIKELSEKSLTEDCEKIIKLYSELRHPLMHYDYQYFENLFENKENSELTKNLNLDIFKSLPLVRKMKLNNKVNYLEDNDTLFVLQKTKKAKTLYQIYDALCEQKNGFNKFINDFFVSDGEENTVFKQIINEKFQSEMEFLEKRISESEKKNEKLKKKLDSMKAHFRNINSEDTKEAYFWDIHSSRNYKTKYNERKNLVNEYTKLLGSSKEKKLLREEITKINRQLLKLKQEMEEITKKNSLFRLEYKMKIAFGFLFCEFDGNISKFKDEFDASNQEKIIQYHKNGEKYLTSFLKEEEKEKFNLEKMQKIIQKTEEEDWLLPETKNNLFKFYLLTYLLLPYELKGDFLGFVKKHYYDIKNVDFMDENQNNIQVSQTVEKQEDYFYHKIRLFEKNTKKYEIVKYSIVPNEKLKQYFEDLGIDIKYLTGSVESGEKWLGENLGIDIKYLTVEQKSEVSEEKNKKVSLKNNGMFNKTILLFVFKYYQIAFKLFNDIELYSLFFLREKSEKPFEVFLEELKDKMIGKQLNFGQLLYVVYEVLVKNKDLDKILSKKIDYRKDKSFSPEIAYLRNFLSHLNYSKFLDNFMKINTNKSDENKEVLIPSIKIQKMIQFIEKCNLQNQIDFDFNFVNDFYMRKEKMFFIQLKQIFPDINSTEKQKKSEKEEILRKRYHLINKKNEQIKDEHEAQSQLYEKILSLQKIFSCDKNNFYRRLKEEKLLFLEKQGKKKISMKEIKDKIASDISDLLGILKKEITRDIKDKLTEKFRYCEEKLLNISFYNHQDKKKEEGIRVFLIRDKNSDNFKFESILDDGSNKIFISKNGKEITIQCCDKVLETLMIEKNTLKISSNGKIISLIPHYSYSIDVKY

SEQ ID NO: 229 - protein, 668 aa, Fusobacterium necrophorum
MTEKKSIIFKNKSSVEIVKKDIFSQTPDNMIRNYKITLKISEKNPRVVEAEIEDLMNSTILKDGRRSARREKSMTERKLIEEKVAENYSLLANCPMEEVDSIKIYKIKRFLTYRSNMLLYFASINSFLCEGIKGKDNETEEIWHLKDNDVRKEKVKENFKNKLIQSTENYNSSLKNQIEEKEKLLRKESKKGAFYRTIIKKLQQERIKELSEKSLTEDCEKIIKLYSELRHPLMHYDYQYFENLFENKENSELTKNLNLDIFKSLPLVRKMKLNNKVNYLEDNDTLFVLQKTKKAKTLYQIYDALCEQKNGFNKFINDFFVSDGEENTVFKQIINEKFQSEMEFLEKRISESEKKNEKLKKKFDSMKAHFHNINSEDTKEAYFWDIHSSSNYKTKYNERKNLVNEYTELLGSSKEKKLLREEITQINRKLLKLKQEMEEITKKNSLFRLEYKMKIAFGFLFCEFDGNISKFKDEFDASNQEKIIQYHKNGEKYLTYFLKEEEKEKFNLEKMQKIIQKTEEEDWLLPETKNNLFKFYLLTYLLLPYELKGDFLGFVKKHYYDIKNVDFMDENQNNIQVSQTVEKQEDYFYHKIRLFEKNTKKYEIVKYSIVPNEKLKQYFEDLGIDIKYLTGSVESGEKWLGENLGIDIKYLTVEQKSEVSEEKIKKFL

SEQ ID NO: 230 - protein, 1121 aa, Fusobacterium perfoetens
MGKPNRSSIIKIIISNYDNKGIKEVKVRYNKQAQLDTFLIKSELKDGKFILYSIVDKAREKYRYSFEIDKTNINKNEILIIKKDIYSNKEDKVIRKYILSFEVSEKNDRTIVTKIKDCLETQKKEKFERENTRRLISETERKLLSEETQKTYSKIACCSPEDIDSVKIYKIKRYLAYRSNMLLFFSLINDIFVKGVVKDNGEEVGEIWRIIDSKEIDEKKTYDLLVENFKKRMSQEFINYKQSIENKIEKNTNKIKEIEQKLKKEKYKKEINRLKKQLIELNRENDLLEKDKIELSDEEIREDIEKILKIYSDLRHKLMHYNYQYFENLFENKKISKEKNEDVNLTELLDLNLFRYLPLVRQLKLENKTNYLEKEDKITVLGVSDSAIKYYSYYNFLCEQKNGFNNFINSFFSNDGEENKSFKEKINLSLEKEIEIMEKETNEKIKEINKNELQLMKEQKELGTAYVLDIHSLNDYKISHNERNKNVKLQNDIMNGNRDKNALDKINKKLVELKIKMDKITKRNSILRLKYKLQVAYGFLMEEYKGNIKKFKDEFDISKEKIKSYKSKGEKYLEVKSEKKYITKILNSIEDIHNITWLKNQEENNLFKFYVLTYILLPFEFRGDFLGFVKKHYYDIKNVEFLDENNDRLTPEQLEKMKNDSFFNKIRLFEKNSKKYDILKESILTSERIGKYFSLLNTGAKYFEYGGEENRGIFNKNIIIPIFKYYQIVLKLYNDVELAMLLTLSESDEKDINKIKELVTLKEKVSPKKIDYEKKYKFSVLLDCFNRIINLGKKDFLASEEVKEVAKTFTNLAYLRNKICHLNYSKFIDDLLTIDTNKSTTDSEGKLLINDRIRKLIKFIRENNQKMNISIDYNYINDYYMKKEKFIFGQRKQAKTIIDSGKKANKRNKAEELLKMYRVKKENINLIYELSKKLNELTKSELFLLDKKLLKDIDFTDVKIKNKSFFELKNDVKEVANIKQALQKHSSELIGIYKKEVIMAIKRSIVSKLIYDEEKVLSIIIYDKTNKKYEDFLLEIRRERDINKFQFLIDEKKEKLGYEKIIETKEKKKVVVKIQNNSELVSEPRIIKNKDKKKAKTPEEISKLGILDLTNHYCFNLKITL

SEQ ID NO: 231 - protein, 897 aa, Fusobacterium ulcerans
MENKGNNKKIDFDENYNILVAQIKEYFTKEIENYNNRIDNIIDKKELLKYSEKKEESEKNKKLEELNKLKSQKLKILTDEEIKADVIKIIKIFSDLRHSLMHYEYKYFENLFENKKNEELAELLNLNLFKNLTLLRQMKIENKTNYLEGREEFNIIGKNIKAKEVLGHYNLLAEQKNGFNNFINSFFVQDGTENLEFKKLIDEHFVNAKKRLERNIKKSKKLEKELEKMEQHYQRLNCAYVWDIHTSTTYKKLYNKRKSLIEEYNKQINEIKDKEVITAINVELLRIKKEMEEITKSNSLFRLKYKMQIAYAFLEIEFGGNIAKFKDEFDCSKMEEVQKYLKKGVKYLKYYKDKEAQKNYEFPFEEIFENKDTHNEEWLENTSENNLFKFYILTYLLLPMEFKGDFLGVVKKHYYDIKNVDFTDESEKELSQVQLDKMIGDSFFHKIRLFEKNTKRYEIIKYSILTSDEIKRYFRLLELDVPYFEYEKGTDEIGIFNKNIILTIFKYYQIIFRLYNDLEIHGLFNISSDLDKILRDLKSYGNKNINFREFLYVIKQNNNSSTEEEYRKIWENLEAKYLRLHLLTPEKEEIKTKTKEELEKLNEISNLRNGICHLNYKEIIEEILKTEISEKNKEATLNEKIRKVINFIKENELDKVELGFNFINDFFMKKEQFMFGQIKQVKEGNSDSITTERERKEKNNKKLKETYELNCDNLSEFYETSNNLRERANSSSLLEDSAFLKKIGLYKVKNNKVNSKVKDEEKRIENIKRKLLKDSSDIMGMYKAEVVKKLKEKLILIFKHDEEKRIYVTVYDTSKAVPENISKEILVKRNNSKEEYFFEDNNKKYVTEYYTLEITETNELKVIPAKKLEGKEFKTEKNKENKLMLNNHYCFNVKIIY

SEQ ID NO: 232 - protein, 1111 aa, unidentified
MKSGRREKAKSNKSSIVRVIISNFDDKQVKEIKVLYTKQGGIDVIKFKSTEKDEKGRMKFNFDCAYNRLEEEEFNSFGGKGKQSFFVTTNEDLTELHVTKRHKTTGEIIKDYTIQGKYTPIKQDRTKVTVSITDNKDHFDSNDLGDKIRLSRSLTQYTNRILLDADVMKNYREIVCSDSEKVDETINIDSQEIYKINRFLSYRSNMIIYYQMINNFLLHYDGEEDKGGNDSINLINEIWKYENKKNDEKEKIIERSYKSIEKSINQYILNHNTEVESGDKEKKIDISEERIKEDLKKTFILFSRLRHYMVHYNYKFYENLYSGKNFIIYNKDKSKSRRFSELLDLNIFKELSKIKLVKNRAVSNYLDKKTTIHVLNKNINAIKLLDIYRDICETKNGFNNFINNMMTISGEEDKEYKEMVTKHFNENMNKLSIYLENFKKHSDFKTNNKKKETYNLLKQELDEQKKLRLWFNAPYVYDIHSSKKYKELYVERKKYVDIHSKLIEAGINNDNKKKLNEINVKLCELNTEMKEMTKLNSKYRLQYKLQLAFGFILEEFNLDIDKFVSAFDKDNNLTISKFMEKRETYLSKSLDRRDNRFKKLIKDYKFRDTEDIFCSDRENNLVKLYILMYILLPVEIRGDFLGFVKKNYYDLKHVDFIDKRNNDNKDTFFHDLRLFEKNVKRLEVTSYSLSDGFLGKKSREKFGKELEKFIYKNVSIALPTNIDIKEFNKSLVLPMMKNYQIIFKLLNDIEISALFLIAKKEGNEGSITFKKVIDKVRKEDMNGNINFSQVMKMALNEKVNCQIRNSIAHINMKQLYIEPLNIYINNNQNKKTISEQMEEIIDICITKGLTGKELNKNIINDYYMKKEKLVFNLKLRKRNNLVSIDAQQKNMKEKSILNKYDLNYKDENLNIKEIILKVNDLNNKQKLLKETTEGESNYKNALSKDILLLNGIIRKNINFKIKEMILGIIQQNEYRYVNINIYDKIRKEDHNIDLKINNKYIEISCYENKSNESTDERINFKIKYMDLKVKNELLVPSCYEDIYIKKKIDLEIRYIENCKVVYIDIYYKKYNINLEFDGKTLFVKFNKDVKKNNQKVNLESNYIQNIKFIVS

SEQ ID NO: 233 - protein, 967 aa, Ruminococcus flavefaciens
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNS

SEQ ID NO: 234 - protein, 946 aa, unidentified
MNNKRKTKAKAAGLKSVFFDQKQAVLTTFAKGNNSQIEKKVVNSEVKDLRQPPAFDLELKEKTFYISGKNNINTSRENPLASASLPLSKRQRIRAERIKRAREENRPYHNVKRVGEDDLRAKADLEKHYFGKEYSDNLKIQIIYNILDINKIISPYINDIVYSMNNLARNDEYIDGKIDVIGSLSSTTDYSSFMSPNKDLEKEKKFSFHRENYKKFVEASKPYMRYYGKVFIRDVKKSKLSTGKGEKIEVMYRSDEEIFTIFQILSYVRQSIMHNDIGNKSSILAIEKYPARFVGFLSDLLKTKTNDVNRMFIDNNSQTNFWVLFSIFGLQDHTSGADKICRNFYDFVIKADSKNLGFSLKKIRELMLDLPNANMLRDHQFDTVRSKFYTLLDFIIYQHYLEEKSRIDNMVEKLRMTLKEEEKEVLYAAEAKIVWNAIGAKVINKLVPMMNGDALKEIKRKNRDRKLPQSVIATVQVNSDANVFSGLIYFLTLFLDGKEINEMVSNLITKFENIDSLLHVDREIYKSDEKDLDLEIEKLALFFKGVVRPNAKTDTGAGEISKSFSIFQSAERIIEELKFIKNVTRMDNEIFPSEGVFLDAANVLGVRGDDFDFSNEFVGDDLHSDANKKIINKINGTKEDRNLRNFIINNVVKSRRFQYIARHMNTHYVKQLANNETLNRFVLNKMGDAKIINRYYESISGNTPNIEVRSQIDYLVKRLRSFSFEDLNDVKQKVRPGTNESIEKEKKKALVGLCLTIQYLVYKNLVNINARYTTAFYCLERDSKLKGFGVDVWRDFESYTALTNHFIKEGYLPVRKAEILRANLKHLDCEDGFKYYRNQVTHLNAIRVAYKYINEIKSVHSYFALYHYIMQRHLYDSLQAKAKDSSGFVIDALKKSFEHKIYSKDLLHVLHSPFGYNTARYKNLSIEALFDKNESRPEVNPLSTND

SEQ ID NO: 235 - protein, 919 aa, unidentified
MAKKNKMKPRELREAQKKARQLKAAEINNNAAPAIAAMPAAEVIAPAAEKKKSSVKAAGMKSILVSENKMYITSFGKGNSAVLEYEVDNNDYNQTQLSSKDNSNIQLGGVNEVNITFSSKHGFESGVEINTSNPTHRSGESSPVRGDMLGLKSELEKRFFGKTFDDNIHIQLIYNILDIEKILAVYVTNIVYALNNMLGVKGSESHDDFIGYLSTNNIYDVFIDPDNSSLSDDKKANVRKSLSKFNALLKTKRLGYFGLEEPKTKDNRVSQAYKKRVYHMLAIVGQIRQCVFHDKSGAKRFDLYSFINNIDPEYRDTLDYLVEERLKSINKDFIEDNKVNISLLIDMMKGYEADDIIRLYYDFIVLKSQKNLGFSIKKLREKMLDEYGFRFKDKQYDSVRSKMYKLMDFLLFCNYYRNDIAAGESLVRKLRFSMTDDEKEGIYADEAAKLWGKFRNDFENIADHMNGDVIKELGKADMDFDEKILDSEKKNASDLLYFSKMIYMLTYFLDGKEINDLLTTLISKFDNIKEFLKIMKSSAVDVECELTAGYKLFNDSQRITNELFIVKNIASMRKPAASAKLTMFRDALTILGIDDKITDDRISGILKLKEKGKGIHGLRNFITNNVIESSRFVYLIKYANAQKIREVAKNEKVVMFVLGGIPDTQIERYYKSCVEFPDMNSSLGVKRSELARMIKNISFDDFKNVKQQAKGRENVAKERAKAVIGLYLTVMYLLVKNLVNVNARYVIAIHCLERDFGLYKEIIPELASKNLKNDYRILSQTLCELCDKSPNLFLKKNERLRKCVEVDINNADSSMTRKYRNCIAHLTVVRELKEYIGDICTVDSYFSIYHYVMQRCITKRENDTKQEEKIKYEDDLLKNHGYTKDFVKALNSPFGYNIPRFKNLSIEQLFDRNEYLTEK

SEQ ID NO: 236 - protein, 906 aa, unidentified
  REGION 1..906: note = Synthetic
MEREVKKPPKKSLAKAAGLKSTFVISPQEKELAMTAFGRGNDALLQKRIVDGVVRDVAGEKQQFQVQRQDESRFRLQNSRLADRTVTADDPLHRAETPRRQPLGAGMDQLRRKAILEQKYFGRTFDDNIHIQLIYNILDIHKMLAVPANHIVHTLNLLGGYGETDFVGMLPAGLPYDKLRVVKKKNGDTVDIKADIAAYAKRPQLAYLGAAFYDVTPGKSKRDAARGRVKREQDVYAILSLMSLLRQFCAHDSVRIWGQNTTAALYHLQALPQDMKDLLDDGWRRALGGVNDHFLDTNKVNLLTLFEYYGAETKQARVALTQDFYRFVVLKEQKNMGFSLRRLREELLKLPDAAYLTGQEYDSVRQKLYMLLDFLLCRLYAQERADRCEELVSALRCALSDEEKDTVYQAEAAALWQALGDTLRRKLLPLLKGKKLQDKDKKKSDELGLSRDVLDGVLFRPAQQGSRANADYFCRLMHLSTWFMDGKEINTLLTTLISKLENIDSLRSVLESMGLAYSFVPAYAMFDHSRYIAGQLRVVNNIARMRKPAIGAKREMYRAAVVLLGVDSPEAAAAITDDLLQIDPETGKVRPRSDSARDTGLRNFIANNVVESRRFTYLLRYMTPEQARVLAQNEKLIAFVLSTVPDTQLERYCRTCGREDITGRPAQIRYLTAQIMGVRYESFTDVEQRGRGDNPKKERYKALIGLYLTVLYLAVKNMVNCNARYVIAFYCRDRDTALYQKEVCWYDLEEDKKSGKQRQVEDYTALTRYFVSQGYLNRHACGYLRSNMNGISNSLLTAYRNAVDHLNAIPPLGSLCRDIGRVDSYFALYHYAVQQYLNGRYYRKTPREQELFAAMAQHRTWCSDLVKALNTPFGYNLARYKNLSIDGLFDREGDHVVREDGEKPAE

SEQ ID NO: 237 - protein, 933 aa, Ruminococcus flavefaciens
MKKKMSLREKREAEKQAKKAAYSAASKNTDSKPAEKKAETPKPAEIISDNSRNKTAVKAAGLKSTIISGDKLYMTSFGKGNAAVIEQKIDINDYSFSAMKDTPSLEVDKAESKEISFSSHHPFVKNDKLTTYNPLYGGKDNPEKPVGRDMLGLKDKLEERYFGCTFNDNLHIQIIYNILDIEKILAVHSANITTALDHMVDEDDEKYLNSDYIGYMNTINTYDVFMDPSKNSSLSPKDRKNIDNSRAKFEKLLSTKRLGYFGFDYDANGKDKKKNEEIKKRLYHLTAFAGQLRQWSFHSAGNYPRTWLYKLDSLDKEYLDTLDHYFDKRFNDINDDFVTKNATNLYILKEVFPEANFKDIADLYYDFIVIKSHKNMGFSIKKLREKMLECDGADRIKEQDMDSVRSKLYKLIDFCIFKYYHEFPELSEKNVDILRAAVSDTKKDNLYSDEAARLWSIFKEKFLGFCDKIVVWVTGEHEKDITSVIDKDAYRNRSNVSYFSKLMYAMCFFLDGKEINDLLTTLINKFDNIANQIKTAKELGINTAFVKNYDFFNHSEKYVDELNIVKNIARMKKPSSNAKKAMYHDALTILGIPEDMDEKALDEELDLILEKKTDPVTGKPLKGKNPLRNFIANNVIENSRFIYLIKFCNPENVRKIVNNTKVTEFVLKRIPDAQIERYYKSCTDSEMNPPTEKKITELAGKLKDMNFGNFRNVRQSAKENMEKERFKAVIGLYLTVVYRVVKNLVDVNSRYIMAFHSLERDSQLYNVSVDNDYLALTDTLVKEGDNSRSRYLAGNKRLRDCVKQDIDNAKKWFVSDKYNSITKYRNNVAHLTAVRNCAEFIGDITKIDSYFALYHYLIQRQLAKGLDHERSGFDRNYPQYAPLFKWHTYVKDVVKALNAPFGYNIPRFKNLSIDALFDRNEIKKNDGEKKSDD

SEQ ID NO: 238 - protein, 944 aa, unidentified
MAKKSKGMSLREKRELEKQKRIQKAAVNSVNDTPEKTEEANVVSVNVRTSAENKHSKKSAAKALGLKSGLVIGDELYLTSFGRGNEAKLEKKISGDTVEKLGIGAFEVAERDESTLTLESGRIKDKTARPKDPRHITVDTQGKFKEDMLGIRSVLEKKIFGKTFDDNIHVQLAYNILDVEKIMAQYVSDIVYMLHNTDKTERNDNLMGYMSIRNTYKTFCDTSNLPDDTKQKVENQKREFDKIIKSGRLGYFGEAFMVNSGNSTKLRPEKEIYHIFALMASLRQSYFHGYVKDTDYQGTTWAYTLEDKLKGPSHEFRETIDKIFDEGFSKISKDFGKMNKVNLQILEQMIGELYGSIERQNLTCDYYDFIQLKKHKYLGFSIKRLRETMLETTPAECYKAECYNSERQKLYKLIDFLIYDLYYNRKPARIEEIVDKLRESVNDEEKESIYSVEAKYVYESLSKVLDKSLKNSVSGETIKDLQKRYDDETANRIWDISQHSISGNVNCFCKLIYIMTLMLDGKEINDLLTTLVNKFDNIASFIDVMDELGLEHSFTDNYKMFADSKAICLDLQFINSFARMSKIDDEKSKRQLFRDALVILDIGNKDETWINNYLDSDIFKLDKEGNKLKGARHDFRNFIANNVIKSSRFKYLVKYSSADGMIKLKTNEKLIGFVLDKLPETQIDRYYESCGLDNAVVDKKVRIEKLSGLIRDMKFDDFSGVKTSNKAGDNDKQDKAKYQAIISLYLMVLYQIVKNMIYVNSRYVIAFHCLERDFGMYGKDFGKYYQGCRKLTDHFIEEKYMKEGKLGCNKKVGRYLKNNISCCTDGLINTYRNQVDHFAVVRKIGNYAAYIKSIGSWFELYHYVIQRIVFDEYRFALNNTESNYKNSIIKHHTYCKDMVKALNTPFGYDLPRYKNLSIGDLFDRNNYLNKTKESIDANSSIDSQ

SEQ ID NO: 239 - protein, 954 aa, Eubacterium siraeum
MGKKIHARDLREQRKTDRTEKFADQNKKREAERAVPKKDAAVSVKSVSSVSSKKDNVTKSMAKAAGVKSVFAVGNTVYMTSFGRGNDAVLEQKIVDTSHEPLNIDDPAYQLNVVTMNGYSVTGHRGETVSAVTDNPLRRFNGRKKDEPEQSVPTDMLCLKPTLEKKFFGKEFDDNIHIQLIYNILDIEKILAVYSTNAIYALNNMSADENIENSDFFMKRTTDETFDDFEKKKESTNSREKADFDAFEKFIGNYRLAYFADAFYVNKKNPKGKAKNVLREDKELYSVLTLIGKLRHWCVHSEEGRAEFWLYKLDELKDDFKNVLDVVYNRPVEEINNRFIENNKVNIQILGSVYKNTDIAELVRSYYEFLITKKYKNMGFSIKKLRESMLEGKGYADKEYDSVRNKLYQMTDFILYTGYINEDSDRADDLVNTLRSSLKEDDKTTVYCKEADYLWKKYRESIREVADALDGDNIKKLSKSNIEIQEDKLRKCFISYADSVSEFTKLIYLLTRFLSGKEINDLVTTLINKFDNIRSFLEIMDELGLDRTFTAEYSFFEGSTKYLAELVELNSFVKSCSFDINAKRTMYRDALDILGIESDKTEEDIEKMIDNILQIDANGDKKLKKNNGLRNFIASNVIDSNRFKYLVRYGNPKKIRETAKCKPAVRFVLNEIPDAQIERYYEACCPKNTALCSANKRREKLADMIAEIKFENFSDAGNYQKANVTSRTSEAEIKRKNQAIIRLYLTVMYIMLKNLVNVNARYVIAFHCVERDTKLYAESGLEVGNIEKNKTNLTMAVMGVKLENGIIKTEFDKSFAENAANRYLRNARWYKLILDNLKKSERAVVNEFRNTVCHLNAIRNININIKEIKEVENYFALYHYLIQKHLENRFADKKVERDTGDFISKLEEHKTYCKDFVKAYCTPFGYNLVRYKNLTIDGLFDKNYPGKDDSDEQK

SEQ ID NO: 240 - protein, 12 aa, synthetic construct
  REGION 1..12: note = Synthetic Peptide
FWYHKMILVAGC

SEQ ID NO: 241 - protein, 12 aa, synthetic construct
  REGION 1..12: note = Synthetic Peptide
WYHKREDCSTNQ

SEQ ID NO: 242 - protein, 9 aa, synthetic construct
  REGION 1..9: note = Synthetic Peptide
VCAGSPTND

SEQ ID NO: 243 - protein, 229 aa, Rattus rattus [sequence omitted]

SEQ ID NO: 244 - protein, 236 aa, Homo sapiens
MTSEKGPSTGDPTLRRRIEPWEFDVFYDPRELRKEACLLYEIKWGMSRKIWRSSGKNTTNHVEVNFIKKFTSERDFHPSMSCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWR

SEQ ID NO: 245 - protein, 325 aa, Homo sapiens
MELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQNQEN

SEQ ID NO: 246 - protein, 208 aa, Petromyzon marinus
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAV

SEQ ID NO: 247 - protein, 200 aa, Homo sapiens
MDSLLMNRRKFLYQFKNVRWAKGRRETYLCYVVKRRDSATSFSLDFGYLRNKNGCHVELLFLRYISDWDLDPGRCYRVTWFTSWSPCYDCARHVADFLRGNPYLSLRIFTARLYFCEDRKAEPEGLRRLHRAGVQIAIMTFKDYFYCWNTFVENHERTFKAWEGLHENSVRLSRQLRRILLPLYEVDDLRDAFRTLGLLD

SEQ ID NO: 248 - protein, 181 aa, Homo sapiens
MDSLLMNRRKFLYQFKNVRWAKGRRETYLCYVVKRRDSATSFSLDFGYLRNKNGCHVELLFLRYISDWDLDPGRCYRVTWFTSWSPCYDCARHVADFLRGNPNLSLRIFTARLYFCEDRKAEPEGLRRLHRAGVQIAIMTFKDYFYCWNTFVENHERTFKAWEGLHENSVRLSRQLRRILL

SEQ ID NO: 249 - protein, 9 aa, synthetic construct
  REGION 1..9: note = Synthetic Peptide
GGSGGSGGS

SEQ ID NO: 250 - protein, 25 aa, synthetic construct
  REGION 1..25: note = Synthetic Peptide
GGGGSGGGGSGGGGSGGGGSGGGGS

SEQ ID NO: 251 - protein, 30 aa, synthetic construct
  REGION 1..30: note = Synthetic Peptide
GGGGSGGGGSGGGGSGGGGSGGGGSGGGGS

SEQ ID NO: 252 - protein, 35 aa, synthetic construct
  REGION 1..35: note = Synthetic Peptide
GGGGSGGGGSGGGGSGGGGSGGGGSGGGGSGGGGS

SEQ ID NO: 253 - protein, 45 aa, synthetic construct
  REGION 1..45: note = Synthetic Peptide
GGGGSGGGGSGGGGSGGGGSGGGGSGGGGSGGGGSGGGGSGGGGS

SEQ ID NO: 254 - protein, 60 aa, synthetic construct
  REGION 1..60: note = Synthetic Peptide
GGGGSGGGGSGGGGSGGGGSGGGGSGGGGSGGGGSGGGGSGGGGSGGGGSGGGGSGGGGS

SEQ ID NO: 255 - protein, 5 aa, synthetic construct
  REGION 1..5: note = Synthetic Peptide
GGGGS

SEQ ID NO: 256 - protein, 10 aa, synthetic construct
  REGION 1..10: note = Synthetic Peptide
GGGGSGGGGS

SEQ ID NO: 257 - protein, 20 aa, synthetic construct
  REGION 1..20: note = Synthetic Peptide
GGGGSGGGGSGGGGSGGGGS

SEQ ID NO: 258 - protein, 40 aa, synthetic construct
  REGION 1..40: note = Synthetic Peptide
GGGGSGGGGSGGGGSGGGGSGGGGSGGGGSGGGGSGGGGS

SEQ ID NO: 259 - protein, 50 aa, synthetic construct
  REGION 1..50: note = Synthetic Peptide
GGGGSGGGGSGGGGSGGGGSGGGGSGGGGSGGGGSGGGGSGGGGSGGGGS

SEQ ID NO: 260 - protein, 55 aa, synthetic construct
  REGION 1..55: note = Synthetic Peptide
GGGGSGGGGSGGGGSGGGGSGGGGSGGGGSGGGGSGGGGSGGGGSGGGGSGGGGS

SEQ ID NO: 261 - protein, 32 aa, synthetic construct
  REGION 1..32: note = Synthetic Peptide
LEPGEKPYKCPECGKSFSQSGALTRHQRTHTR

SEQ ID NO: 262 - protein, 20 aa, synthetic construct
  REGION 1..20: note = Synthetic Peptide
PKKKRKVEASSPKKRKVEAS

SEQ ID NO: 263 - skipped

SEQ ID NO: 264 - DNA, 27 bp, synthetic construct
  misc_feature 1..27: note = Synthetic Oligonucleotide
  source 1..27: mol_type = other DNA
ggtggtagtggagggagcggcggttca

SEQ ID NO: 265 - DNA, 72 bp, synthetic construct
  misc_feature 1..72: note = Synthetic Oligonucleotide
  source 1..72: mol_type = other DNA
ggtggaggaggctctggtggaggcggtagcggaggcggagggtcgggtggtagtggagggagcggcggttca

SEQ ID NO: 266 - DNA, 48 bp, synthetic construct
  misc_feature 1..48: note = Synthetic Oligonucleotide
  source 1..48: mol_type = other DNA
tcgggatctgagacgcctgggacctcggaatcggctacgcccgaaagt

SEQ ID NO: 267 - DNA, 192 bp, synthetic construct
  misc_feature 1..192: note = Synthetic Oligonucleotide
  source 1..192: mol_type = other DNA
gtggataacaaatttaacaaagaaatgtgggcggcgtgggaagaaattcgtaacctgccgaacctgaacggctggcagatgaccgcgtttattgcgagcctggtggatgatccgagccagagcgcgaacctgctggcggaagcgaaaaaactgaacgatgcgcaggcgccgaaaaccggcggtggttctggt

SEQ ID NO: 268 - DNA, 108 bp, synthetic construct
  misc_feature 1..108: note = Synthetic Oligonucleotide
  source 1..108: mol_type = other DNA
ggtggttctgccggtggctccggttctggctccagcggtggcagctctggtgcgtccggcacgggtactgcgggtggcactggcagcggttccggtactggctctggc

SEQ ID NO: 269 - protein, 12 aa, synthetic construct
  REGION 1..12: note = Synthetic Peptide
FWYHKMILVAGC

SEQ ID NO: 270 - protein, 12 aa, synthetic construct
  REGION 1..12: note = Synthetic Peptide
WYHKREDCSTNQ

SEQ ID NO: 271 - protein, 9 aa, synthetic construct
  REGION 1..9: note = Synthetic Peptide
VCAGSPTND

SEQ ID NO: 272 - protein, 849 aa, synthetic construct; identical to SEQ ID NO: 62
  REGION 1..849: note = Synthetic Peptide

SEQ ID NO: 273 - protein, 802 aa, synthetic construct
  REGION 1..802: note = Synthetic Peptide
MQVENIKKGSSQGMYSIEQYEGAKKWCFAIVLNRAQTNLQGNPKLFEETLTRFERIRKEDWFDQETKKLIYAKQEQNEVEEEIQKAADEKLRDLRNYFSHYFHTPDCLIFTQNDPVRIIMEKAYEKARFEQAKKEQEDISIEFGELFEENGRITSAGVVFFASFFAERRFLNRLMGYVQGFTRTEGEYKITRDVFSTYCLRDSYSVKTPDHDAVMFRDILGYLSRVPSESYQRIKESQMRSETQLSERKTDKFILFALNYLEDYGLEDLADYTACFARTRIKREQDENTDGKEQKPHRKKPRVEIHFERAEGDPFYIKHNNVILRTQKKGAQTYIFRMGVYELKYLVLLSLLGKGAEAVKRIDRYVHSLRNQLPHIEKKSTEEIEGYVRFLPRFVRSHLGLLGVDDEKKIKARVDYVKAKWLEKKEKSRELQLHRKGRDILRYINERCERPLNIDEYNRILELLVTKHLDGFYRELEELKKTRRIDKNIVCNLSRHKSVNALHEKVCDLVVQELESLGREELKEYVGLIPKEEKEVSFEEKTDRVVKQPVIYKGFLRNEFFRESRKSFARLVEEAVREKGEVYDVPLGGEYYEIVSLDTFDKDNKRLYETLAMDRLLLMIARQYHLSLNKELAKRAQQIEWKKEDGEEVIIFTLKNPAQPEQSCSVRFSLRDYTKLYVMDDAEFLARLCDYFLPKDEEQIDYHRLYTQGMNRYTNLQREGIEAILELEKKTIGPEQPRPPKNYIPFSEIMDKSAYNEDDQKALRRVRNALLHHNLNFARADFKRFCGIMKREGIEKRWSLAV

SEQ ID NO: 274 - protein, 775 aa, synthetic construct; identical to SEQ ID NO: 48
  REGION 1..775: note = Synthetic Peptide

SEQ ID NO: 275 - DNA, 8604 bp, synthetic construct
  misc_feature 1..8604: note = Synthetic Oligonucleotide
  source 1..8604: mol_type = other DNA
agctgtcccgctgagcttattaacaagcattaccgctaaattttccgcggactgttggttttcagcttcgtgaatgccaacaacaaaaggccctgtcgaaagcacaatttcggtggtgtcatagaaatccaggactttgccttcgagggttttattggttgccttctttgctgtggcgccattttcaatcagaaagctgcgatagctttctgcgactgcctcggcatctttgggaccggagcgtttgctcagaaatgccgtgatggtttcaccgttaagctggtatccggcagcgaagatgtcagtcaatccttcaaagccaaatgcacttgccagataaagcttaatgcttcctgggaccaaattatcctttggcaggtgctcgatttcaggtatagcggtatcatcgtgaacggccaggttcgtgggaattttccttgcgacttccgccattgccgcaaacagctcatccgattcggcgaagccgaccagctcgatataatattggccgtgcgcaagataaaacgcattactggttttgtatgcaaattgcatatccggcaggttctcaacttcgggccttttttgcacgctgtaaaccgagaatgcgtttctggttctggccatatcaaagatatagagctccatcaccaggttttcatccgcctggcttacaaatctctgggtggacaattttataaaaccagcgtcgatataaaggggggccttgccgttaatcttttcgtaaagattttcggtggtgtagacttcaatttctgaaagcgttttgaatccgtaaggcagaagaaaagtcaggtctttcttttgttttggcatctgctttatgaataccccaacggcgataagtaagagaatcgctaataagcagatgcctataacagattcgagacgttttgcccggcttggtaccgaacccataaccaactccagtaatgacaaattacttgactttataaccgggctggattataatttttgccggtgttgctgtcaaccccaaatgctacaggtgaaaaaggcgaagatagatttctaacgaggttgacaaagcaggtcagggcgtgttataataggttgctaaagtaaaaaggagactgaaatgattgaatatgcacaatatttggggttttggacgccgggcccccttgaaattgctgttattgcgattgtcgctcttctgatattcggcagacggctgcctgaaatcgcccgcaacgtaggcaagagcctgactgaattcaagaaggggcttcacgaggccaaggagaccaaggacgaattggtggatgatgtccgggaagtcaaggatgatgtggtaagagaggcgaaggatgccgccgggctgaatgaagaggatacaatgggctctgattgattattgataaaggggaactaatcactgagaacaattgtcaatcattaatcaacaatcaatattgaagatccgcctgtggcggaatcaatttttaagatgggcgatacaaagaagaaagaggacctccttgattccactatgagtctgggcgaccaccttgaggaattgcggatgcggctgattcgcgcgctggtgggcctggcgttagctcttattatctgtctgatcttcggcaagctgctgatatcatttattcaaaaaccttacgttgctgtgatgggtgaagaggctactctgaagacgcttgccccggcccaagggattaacagctacgtaaaaatagccttggtctcaggcttgatattctcatcgccctgggtcttctaccagttatggatgttcgtggctgcaggactctatcctaatgaaaaaagatatgtgtatgtagcagtacctttttcggtggtattatttgttgccggagctttgtttttcatctttgtagtggcagaagtgtctcttgctttcttaataaaggtcgacaggtggctcggactggaacccgactggactttcccgaagtatgtgacctttgtaaccaccctgatgctggtatttggtgttgcgtttcagaccccgatagctattttctttttgaacaagacaggtctggtttcagtccaggcgttacggcggtcaagaaaatatgtactgctacttatcgttgtagtagcagctatggcgactccgcctgatgtggtttctcaagtaacactggcgataccgttgtatgtgctgtttgaattaggcatactgctgagttactttgcagaactaaaaaagagaaagtcgaaaaacaaccagtgataagccgacaatccccagctttcccagtaccgactacttgtttctttcgggcctggtttttatttcgtcaatcgagcgactaagaaatcttcaaaggcgcttaaatccttccataccgtggcacagttaatggttttggctttgttatctattacggtgtatccatagtcggtaacccgaatgccgagtttttcgggctcattttagacatttgcatctatgccgccggcagcgctgaaggttttttcggagctaattgagtattcagcataaatgttgaacggttttgccaatgcgggtactatgatgttgatgctaacgttgataaatacaaatgtgatggtccctcccatagggcctgtcggcctggactatatcgcaggagccgtcagggcagccgggaaccaggcagacgtagttgatttatgtcttgctgatgacccgtcaaagactctccagggctatttcgctacgcacagcccgcaattggtgggggtctcttttcgcaatgtggacgattctttctggccaagcgcccggtggttcgtccccgacctggctgacactatccgtacgatacgaagtatgacggatgcaccaattgtagttggcggcgttggcttttccattttttccgagcgaatcgtcgaatataccggcgctgactttgggattcggggcgacggagagcaggcaatagtttcacttcttaatcagctgcagcggccggaacggcttgaacgcatagatgggttagtccggcggcgcgacggagttattcacagcaaccgaccagcgtggcctgcaccgctttctttgcgcaccgaacgtgatgcgattgataacctcgcttacttcaaaaaaggagggcagtgtggtgtggagaccaaacggggctgtaaccgccgatgcctatattgtgccgacccgctggctaagggtgcggcagtcaggccgagggccccgtcggaggtcgccgatgaggtccagtctctaataggcaagggaatagaagtattgcatttgtgcgactctgagttcaacatctctcaaagccacgcctatgcggtctgcgaagagttcagccgtcgctcatttgcgaaaaaggtgcgctggtacacatatatggcggtggtgccattcgatgccgagcttgccggggctatgagcagagcgggctgtgtcggtatcgactttaccggcgactctgcgtgcccatcaattctaaagacctatcgccagcggcatcataaagaagaccttgcctcggcggtgcgtttgtgccgtgctaacggcataacggttatgatagacctgctgtttggcggcccgggtgaaacgccggaaacggtcgcagagacaatagatttcattaagcaaattgacccggattgcgcaggggctccgctcggtataagaatctaccccggcaccgaaatggcccgaatagtggcaaacgaaggcccaccggaaacgaacccgaacgttcaccgaaagtacgaggggcctgtggatttcttcaaaccaacttactatatatctgaagccctcggtgagcagccggccgggcttatcaaggatttgatttcggcagatgaaagattctttgagccgatgccggaaatagccccggaggctctaaaaagtagccagtccaccgaccacaattacaatgataataccgaacttgtagaagcaatcagcaaaggtgcacgcggggcatattgggatatactgcgcaagcttcgctgcgactaagcagcttatggtagtagatgattcccgcctgcgggagattggcccgaatcctgaggaatttgttagaagcggatgcaatgttgatttttggggtaaaaacgggggcagggggatttggtccccggtttgaggattccgagaagcccacccgtagggatctccgctcccttagggataaattcgcttcgagtttgaaattggtccccggtttgaggattccgagaagctcacccgtagtgatctccgcttcgcttcggctttgtttgggtttgttttccccgcgtctgcgaagtggttcattttcataatcctttataacatataagtttacgttcattttgggctttcggcaaattgggtttgaattgggtttgtttttttggactgcgaaatcatctttttttctgtaaacctttgttataagagagtttacattcatttgggcatttagtaaattgggtttgattggctttgaattgggtttgttttcaccaagtgtccaattggatttattttcataatcctttgtattatatggatttacgttcatttgagcatccagaaaattggctttgttttgcataaaaagggctgatttgtagaggactctttacagttgtagagggcaagttagttaagagtgagctaaagtgcctaaagtgaactaaagttggattctcgattctcgtatagcgtatagcgtatttcacggttattcaccattcattaaggaataaatttgattaggcctgctggcccctccggcgattagtaaatggttctcggcggcaaaacaacgcgcctctataattgggcgaacatgcacgtttgagtcgaaaattggtgctttcttgacaggataaacaggagtaactcgttgtgagaaaaggagtaaaattttttttcaattttccgattttaggttccaactacctgcacttttgattgaaaaatcacaaatgtcttgcctattttaacgcagtttttcgtcgaaacgtcagcgaactaggaaaataggcgatttctgggggaaaacaaataaaaaatgcacaaaagtgacaaaaaaacggccaaaaaagtgctttttttggctgcctttaccccgtgagatgatttaccaaaccttcctctgctattcctatgcaagtttgctcagggctggtgtgaatactataaaaatttgtgctgtaatcactccacaaatcggaggcttcttcagcgtggaaattctggaggccaaaatgaaatacgctgtaatcaccccacaaatcggaggcttcttcagcttcactacctctcaaatcgcccaactatacgctgtaatcaccccacaaatcggaggcttcttcagctcgcaagtcccgtccacgcacaaagtttgagctgtaatcaccccacaaatcggaggcttcttcagcatgagcttttggttgtgctggatatgccagctgtaatcaccccacaaatcggaggcttcttcagcacaaaacggttcaacaaggtcgaagaactagctgtaatcaccccacaaatcggaggcttcttcagcttctgcggagtctttcgccggtgttcaaatgctgtaatcaccccacaaatcggaggcttcttcagcctatcctttataatacattttcctatatagatttacaatacaaaacccacgacaaaactgacttcttcttttgaatcatgccgtattataacacttttttacactatcaaagaccactttttttctattccttctcttttcacgaccccatagaatctcttcagatgttccctctcaaaattgagattatagtgcaaaagcgcatttcgcacccgctttaaagcaacctgttgatcattattataaccgcttctattcattatctcctgaaattctatataattttttgctggtttaatctttcttcgttcgataatccttccttcaagctttagtattgcatcgattccctctttttgaaggtttgtatatttgtcgaacgcccttgcatagtgcttatggtagtctatttcttttgcttcttttgggataaaatattcccaaagtctgcttaaaaattcaggatcgtccattacatacatctttgtataatccaagatcgaaaagcgtatcgaaaaactcttcttttgctcttttggattttggaatttgaaaataatcacttctctgccatcttccttcttccaatagatatgctgtgccttttctgcaagtttttcgttcaatctgagataatattgccttgccatcataaggcaaagtctgtccattgccagtgtttcatatagcttcttgtttgttctgtcaaatcgatcaagagatgggatgttataatactcttcaccaagaggaatatcaaaatccgaccactttgtcttaattgcttcttcaacaagtctggcaaaactctttttgtcttctttgaagaattcgtatctcaaaaatcccttataaacaaccggctgttccaaaatcctatctaccttttctctaaaagttacctctttttcttctttaggtatcagcccaatatattccttgagattctccgattgcaaactgcccagttcttgtagaaccaaatcacataccctttcatgaagtgcattgagcgttgtatgcccggaaagcttctggataatatttttgtctaatcgtctggttcttttcagttcttcaagttcattataaaatccggcgaagtctttgttcactataaactttaaaatattattatattccttcctgctaagtggcctatcgcatcgctcgttgatatatctgagtatatcccttccttttcgatgtagttcaagcttcctcgatccctcttttttatccgtccacttggccttaacatattccaatcgagtctttaaccttttctcatcatcaacctgtaaaagacctagtcttgaacgtacgaatcttggaaggaagtttatagatttttgaatctcctcattacttattttatctaaataaggcaactgcttctttaaactactaatatagcggtcaattctttgaattgcctcttcggcttttcccaatagactcaaaagaacaagatatttaagttcataaactcccatcctgaatacgttggactgtccaccttttttttgagccttcagaataacattatttcgtttaatataaaattggtcttgcttctctttgtcaaaatgaatctcgactaccggcttttccctgtgaaatttgtgtttgttaccatctgtctctttcgtatcttcgttctcccttttaattttacttcttgcaaaacatgctgtgtagtctgccaaatccttaagtccataatcctcaagatatttcagtgcaaataatatgaacttgtccgtctttctttcgctcaactgatcctggcttctctttcgagttagtttgatatgctgatatatctcagtgggaactcgggacaggtatccgagaatatccctgaacataactgcatcatggtcctgcgcctgaaccgaataactatccttaagacaatatttggaaaaaacttgccgtgttatattatattcaccctctgtttttctaaacccttggacatatcccattaagcgatttaaaaatcttctttcaataaaaaatgagacaaagaatactacacctgctgatgttatcttatcttcttcttcaaataactctggaaattcaatcgaaatatcttcttgttgttttttcttcgcttcaaaacggctcttttcgtatgctttttccataattatccttatggtgtcatttcgattgaatatcaggcagtcaggcgcgtgaagataatgtgagaaataattccttaaattctttagtctttcactggccgctatttgaatttcttcttttactttgttttcctcttctttttcataaatcagtttttttgtttcctcattaaaccaatcctgtttcatgattttttcaaatcttgtaagtgtttgctcaaataactttggattttcctctaaatttgtttgtgctctattaagaactattgcaaaacaccactttttttctccttcatattgctcgatagaatacacttctttattgcttgttttttttatattttcaaactccatatttttaatccccgatcttcttactaatataaagtcaaagtggtgcgaaatatcgcaccctaccctctgcctgcgcaggaaagaccaacggacgattcgatgcagtttgagctgccaggtgcttttatcattcaaggggtaaaatagcagaaaagccttaatgtgtcaaggggattttagatttactatttccaatttacgattttggattgagattgcttcggcctaaaagacaggcctcgcaatgacccccttagagttgaaagcactctaaacaagggggcaggcggggggaatatcgaatatcgaatctgaatgtccaatgtcgaagtgcaactgcgcgggaatgacaggtcggcagatttatttaattctgtggccagatccctccgcttcgtccacctgcggtggacttcggtcgggatgacactgggggtgtgccattgctccgctcg

SEQ ID NO: 276 - DNA, 5375 bp, synthetic construct
  misc_feature 1..5375: note = Synthetic Oligonucleotide
  source 1..5375: mol_type = other DNA
agccgagtcgatggtagctaaggtgaacgacaagcgtggttatacggagataagttgatgcgactggttatccatgaggacgaagtagattcgatggattggttatatggaattagatcgaaacgtatacctatgaagctcacagtcaaataccaatcgggatagaaatgcggcgcgcgcaaccttaggcaaaggcttggctgtttcagcgtttccgctttacgtgcccgtttagccttcaccatagtccacctttccgcaagcctccctgcgatcccggacagtcggatttcccaaatccggttctggtctcggccctatttgtcattttctggataaaggccttcctgtacaatttgagacttaagtgctagctcacttgcaccccataattgtacagtttaccagtatcctcgttccgagagtccatggcattcgttccagttcggtgcctggatgcacatgccttactcagaaccaccgagtacccagagcccctttgtcaggcgtgggcgctacccactacctggatgactttgaaagtcacctcagaagacattactcttccttcatagctcatacggactcatgcgccagaccaaatccctcccaacgtcttggttttcccttgtacgttaggtctttgcaggttgtcgccagtccctgctgggaaacggcccttcccgacattatctctgcaatccttgtataggtgcaaggacccttaccccgcagcgtcccttcggtgcccttgcccgtttcttcccgaaggactgcggtctcacctcaggatttaaaggttcgacacgccaattatccgtcgcaatgcaacttcaacaacggggcaaatttcggggctgcagtcattccataacgttcaagctcctatacctgctatgccctgcggttgcacccaccactgagcatatatgagctcagggcagccgggccgtttacaccacgcatcgcccggatggttacccattccgagatgtggcatcgctacgtgcctgaatcgggcaactggcacgacgggactttcacccgctggattgcagccttgtcggctgctccaaatccctgttgccacaaaaattttctttgaggcatccacgttacgacgtgtcggccacgcttcgtagcttatctgaacagcctttcgacttcacgatgcattataatggacatcgtgaatctagctatgtcatggtcaatcgtagtgtggccaggggccggccaatcgagtatacttgataaagtgttcatgaagctgtattctttaatctcccaagagtatgcttcgaacgtttaagaaatgacagatagtggtgaagtggtctgaaaacgggcccgggaggcgaagacgtgagtacaggtacagtgaaatggtttaatgcaagaaggggatacggttttattgtccccgatgatggcggagatgatttatttgttcaccgttcggacattaacacagaggactatgcatcgcgagattattaaggtcggcaacgacatggttgccgaccatatcaatcataagggcttggataatcgcaaggccaatttgcgagcggcgacgattgcgcagaatgcgtggaaccgccagcgcaaaagaagcggatttatgggcgtagtgtggaataagcagatgaggaaatggcgtgttaatatcagtcacgagggcacgtgcaggcatatcggctacttcgatgatgaggttgaagcggcgaaggcgcacgaccgggcagcgaaaaaatatcacggagagttcgcgagtttgaatttcacgcgttaaagccacatcacagcgagtccgactatggcggacgcagcaatcttaagcatatttggctgcgcaatgtgttgcgcgggttcctgcttggggcgagctatcgaggtgtaatcaccccacaaatcgggggcttctccagcgccgtaaaagttgataagaattttagatgcgccgtaatcacccctcaaatcgggggcttctccagcgctgaccgaattgataaaaccaagagagcgctgtaatcaccccacaaatcgggggcttctccagctgtacgacaaatcataacagaatatttgaagctgcaatcaccccacaaatcgggggcttctccagcaaaatgagacaccacgcttgacgtcactgtgctgtaatcaccccacaaatcgggggcttctccagcttcgagctatatctggctcggtctgatttggctgtaatcaccccacaaatcgggggcttctccagcactggcttagcaagttcctttgggcgtttcgctgtaatcaccccacaaatcgggggcttctccagctaatcgaagatgagaccgaagactatcactgctgtaatcaccccacaaatcgggggcttctccagctgattgggaaagcactccttacgcacgagagctgtaatcaccccacaaatcgggggcttctccagcacatcctcgataatacgttatctcgattggatttacaacagaaaaatcactgaaaataccagggtttttggtgcaatgcgcacacattagaacctgttttcatactgctaaagaccagcgtttttcaatcccttcccttttcataattccacagaacctcttaaaatctgccctggcaaaattaaggttatgatgcaaaagcgcgtttcgcacacgtcggagagctttctggtcatcttcattgtaggcgcttttatccattatctcgctaaatgggatgtagttctttggaggtcttggctgctctggaccgatagtctttttctcaagctcgagtatggcttcaattccttccctttgcaggtttgtgtatctgttcatcccttgcgtataaagcctatggtagtcgatttgttcttcgtcttttggcaaaaaataatcgcaaagtcgggccaaaaactccgcgtcgtccatcacatagagtttcgtataatccctcagcgagaaccgtaccgaacaactctgctccggctgtgccggattcttcaaggtgaaaataattacttcttcgccatcctctttcttccactcgatttgctgtgccctcttggcaagctctttgttaagactaagatgatattgccttgcgatcatcagcaaaagcctgtccattgccagtgtttcatacagtctcttattgtctttatcaaacgtatcaagtgacacgatttcgtaatactccccccccagaggaacatcataaacctctcctttttccctcaccgcttcttcaacaagcctcgcaaaactctttctgctttctctgaagaattcattcctcaaaaatcctttataaataaccggctgtttcacaaccctgtccgtcttttcttcaaatgacacctctttttcttctttgggtatcagtccaacatattccttcagttcttctctgcctaggctttcaagttcttgcacgaccaaatcgcacaccttttcgtgcagcgcattgacgcttttatgcctggaaagattgcacacgatgttcttatctatccgtctggtcttcttcaattcttcaagctctcggtaaaacccgtcgaggtgcttagtgaccaaaagctccaaaatacggttatattcatcgatgttcagcggcctctcacaccgctcattgatatacctcagaatatcccgtccttttcgatggagctgaagctccctcgacttttcttttttctccaaccacttggccttaacataatcaactcgcgccttgatctttttttcatcatcaacccctaagagacccagatgggaacgcacaaacctcggaagaaatctcacgtatccttcaatctcttccgtgcttttcttctctatgtgaggcaactggttgcgcaagctatgaacatacctgtcgattcttttgactgcctctgctccttttcctaataagctcagtagaacaagatatttaagctcgtagacgcccatcctgaatatataggtttgggcgcctttcttctgagttcgcagaatgacgttattgtgtttgatataaaatgggtctccttcggctctctcaaaatgaatctcgactctcggcttcttcctgtgaggtttctgctccttgccatctgtattttcgtcctgctcccgcttaatcctcgttctggcaaaacatgctgtgtagtctgccaaatcctccagcccgtaatcctcaagatagttcagcgcaaacaatatgaacttgtccgtctttctttcgcttaactgggtttcgcttcgcatttgcgattctttgatacgctgatacgactcactgggaactcgtgacaaataccccagaatatcccggaacatgaccgcatcatgatccggcgtcttaaccgaataactgtccctaagacaatatgtcgaaaaaacgtcccgcgttattttatattccccctctgtacgcgtaaacccctgaacatatcccattaaccgatttaggaaccttctctcagcaaaaaatgacgcgaaaaataccacacctgctgatgttatcctgccgttctcttcgaacaactccccaaattcaatcgaaatatcttcctgttccttttttgcctgttcaaaacgcgccttttcgtacgctttttccataattatcctgaccgggtcattttgggtgaatatcaggcagtcaggcgtatgaaaatagtgcgagaaataattcctcaaatctctaagcttttcatcagccgctttttgaatttcctcctctacttcgttttgttcttgttttgcatagatcagttttttcgtttcctggtcaaaccaatcttcctttctgatcctttcgaatcgtgtcagcgtttcctcgaacaacttcggattcccctgcaaatttgtttgcgccctattaagcactatcgcaaaacaccacttcttggccccctcatattgctcgatagaatacattccttggctgcttcctttcttgatattttcaacctgcatatctcagactctcccaattgttgtttttcgccatttttgttgaagtccccgaatgtcagtctattgggccagctgagtcaacccacaaggcacaatgtacatacagtctcgagtcatttcgagaagactttccgctcgcccgataagataagctttgagtatctcacggggtggacccgagcagataattccacatctcgtatccggtgaagctatccggcataaattcgtgcttagtgaatcgtgtttcgtgttgatacggctcccggctgcattcacttttcacggcagagaatatcgcaaaataaggcaacagtcaaaggaaaaagggtaaaaatggtgaaatagatgagcgagcagtgaattgttgtggcaagcaagccgcaaatgaatccttcggccacgctc

SEQ ID NO: 277 - DNA, 5615 bp, synthetic construct
  misc_feature 1..5615: note = Synthetic Oligonucleotide
  source 1..5615: mol_type = other DNA
tatccaaaatgtggtttgaattcaagaatcaacgctttattccttaaaaaggggcggtgcgatggaaaaagaaccagaaacatccgtgcaatcggcgtcgggacacaatatggatatcccgattgactggtcggtaacctcacgctatttcgaagatgaagatacgctgatgcaggtggtggggatatttgctgaagactctccgcagaccgtccgggaccttgccaaggctatacagacgcaaatatcccaggatgttcaattgcacgctcacagcctgaagggagcctcggctcttatcggggccgaacatctgcggcaaagagcctggcggcttgaatacgccgcccaggagaaaaacacggcggcgtttgaggcgctgtttgacgagacaaaggccgagttcgacaagctgatgtcgttcctttaccgcgccgattggattgaagcagcaaaagaacgccactgcaacaggcaacaggccgagcaggtatgaaacatcttttggaaaagaaggcgatggaatgagtggatggttctccattttgatcattgatgatgacaggatggttacagacaagttggagaagatcagcggcgccaaggctgcaaagaaaaggttcagcctggcaggcgttttctcaaagggcgcctgaagccctttatttgcaggcgtgctaccgcttgtcaacgggcaggggacagaaccgcaatcaggattaccatcagtttcttcattccattaacctcgctttttcctctcgttctttttcttcttcctggttttcgcagcgttgggctgtctttttgccggttttgtatagttgtcgccgtaaatgtcaatgagtgcggcttttagtttttcgggccagttgcggttttcaaaagcgcacacgagcggatcgccgctttgtttcatccagttatgaagccggccctgcatcttcttgatttcgctcctttgctctgcggaatcgataaggttgttgaggcagtcggggtcatttctgagatcatagaactcctcggccgcgcgatatctgaacatcttgacgcgctgtgcggcgaacttattcgttggagcggcctcgaccatcgccttcatggtaaggccctcgttgttgtttcggtaccagaatctgccgtcggcccacggattgaagatatagccgaagcgcttatcctggacgcaccgcatcgggacagcgtctccgccggctttcatgtctatctgcgtaaagaccacgtcgcgtccggattgcttttcgcctttcaacagccccaggaaagaggaaccgtcaagccccctgggtatgcccagaccgaccgcttcgagcaccgtcgggaagaagtcgatccctgagataaagtgcgccttatcgacggcgcctgcttttaccatttgcggccaacgaacgatccacggcgtccgcgtgctggcaagataggcgttgcattttgcaaacggtatggcgatgccgttgtcggagaggaacatcacaagcgtattctcctcgaagcccgactccttcagggcctgcaacgtcttgccgaaggtatcgtcgagtcggcggacggagttgagatagcagctcagttcctgccgaacgcccggcaggtcgcagacaaaaccgggaaccgcaacctcatcgggcttatacgtctttgaaggttcctttgcccccttgattggcttgccgccgatatgatacgggcgatgcggatcgtgcgagttgaccataaagtagaagggcttattctcgcggcgacacctcgccagaaactccttgcagtaaactgtaatagagttccggatcgcggccggcgccgagttccttctggtcatgcacaaaatcccatttgtaatccgcatggggcgttgagtgccccaccttgccgagaataccggtaagatagccggcatccctcagcgtctgcatgacagtcatcaccaaggcggcgcccaatcctgcggcccttagaaaatcacgacgattcatcattgtccccactaatccttattgttcttctcaagataccccgacaatttctgcatttgccgatacaggccgccgggacatatcagtatagccgcaaaccttgaaaatatcaacctcccggaatataacgtcgacttccaacccagatcgccaatccagaataagaaaacaaagcaaaacgcttcaaattcgtttaaccccagggttcgcctgaggttcgtaaacaccatctcgatgtacatcgggattcaaattcgttgagccccagcccttcttgtggctcttgttcggcaagaaacgctgtaatcaccccacaaatcgggggctgctccagcatcgccaagacgggcaatgccgctttgaggctgtaatcaccccacaaatcgggggctgctccagctgatttcgagtttcgatgctttcggacagggctgtaatcaccccacaaatcgggggctgctccagcactccttatggagaaggagcttatcgtgtcgctgtaatcaccccacaaatcgggggctgctccagcttattccttccatcatcccgacagcagtgggctgtaatcaccccacaaatcgggggctgctccagcccactttcgtaaccattttactcgcaaacgcttataacgaaaacactttccaaaaaccataccaacgtcctcatttaacaggaaacttccactccttttcaattccatatttcttcataacatcactaaacaacccaaattcatctatcacaaactttaaatgatgatggaaaaacgctctacgcaccttattcacggcggtcttctccgcctctttacacattgtttgtgccagtatctcacgaaaatcaatataatgcgccccttccttctcgctcatctttttggctttgacaaccttctcttcaaacgccagcaccgcctcgacacatttcttctgcagatcattatatgccctaaaccctttttcgtaaactgtatgataccgtatcttccctttttcgtgcggcataaagtactcacatatccgcccaagaaactcagcgtcatccaacacatataacttgccgtaatcactcactgagaagacgatgcttttttcgttacccactgagccctccacgggcaactcgatgctatcattcgaccacacaattttattacccaattccttgcgtacactccccaggaagtattgcgccatcatcagacacaaacggtctcgcgccagcgtttcatacaaggctggattagcaccctcgaatcgcccaatcgcatcaatatgataatactttttatccagcccaacgtccctctgtccgccgccgctttccaaatgctcttccacaagcttcgcgaatcccttcttgctgtcataccagaacttcttgcgcaagaaacccctgcggatagaaatatgctccttgaaccatgcaaccttctgcttgtaatctatttcatccttcttcccaagccccacataatcgtagagcttctgatcgccgattcggcaaagtctgttgagaatctgatcacacaccacctgatgcatctcgtttattgtggaggtctgcgcaaaaattgaatatacccgcccgtcgattcgctcggccagttgcaggcgtttcagtcccgcctgaaaattctcaacatccttgccaaccagacacaccagcagccggttgtactcgccgggattgaaagacctcgtgcaattttcatttacgtattgaagaatgtcccgcgccttctcgtgaagtgtcatctcgttggtcgccgccttcttcttttcccacacccctcgaacatgctttactctgccgtctattctttgcttaaaagctttcctgccaatcccatgttgctccagcacaaatcgcggcaggaagacgtgattatccttatctgtgaccttcactacatccagaatgttctccacatgctgccgatacctgtacagttttgcaatcgcatcgtcgccctttccctgaaggctaagcaatacaaggtatttcaattcgttaagccccatgcgataactccgaggcccggcattcttatcaatcctgacgataacattgttcttactgatatagtatgactgatcttcgtctttttttgaaaagtcgacaactaccttgcctttggtcctgtgctttttgtgttcgtcgcctgccccggcctcctccctgacaatgtgtcgccgcccgaagcatatctcactgtgttgcgcctccagataatgcagtgcaaactcgatgaacttgtctttatggcgtttcggattcgtcccctcattgtcgtttgctcttttcttgtcgccctgctctccgtggtagtattcatacgcctccgcagggatgcgtccaagctgcgcgagtatatccctgaaaagcagcacgcgtttgtcccacgccttcgtgaaacgactgtctttcaggcaatacatcgaaagcgccttccgagtcagcttgtactgtccttcgtttttcttaagcccacttaccgcaccgtacaaacgatccagcacccgccgttcaacaaagaacgaaacgaaaaacacaacccccgccgtagtgatccggtcgccttcgaacaggctgggaaactcgatgatcacttcagtttcgcgtctcctgcattcaaagatcgcccgctcatacgccctttccatgattgtccgcaactcatcttctgctgtaaatgtcagacacccgggcgaatgtcgatagtgggagaaatagtttcttaacgcctcggccttcgcattggccgcttgtgtgctacacttgatcaaagcgcgtgtatcctcatcgtaccagtcgtgctttgaatacttttcatggcgtaacagcgactcgacaaaaagcccgtcgttcttatctcgattcacaagagccttgttgaaggcaatcgtaaaacaccatttccgagcaccttgatattcatcgatagacaactctctctttttcgaagtctgctttgacacttgcgccattgagcacctcccattccagattttagtgcgatctttacctcatgcctccacaacactcccagcgccaaacgttgagcaaagcaaaatacgccgcaggcgggctccgtcgaatccgtaatcctaatttctaacttcccaatcatctaaaccgcccgcaaccgatttgtcaaccaaaaaccacatcaatccgcagatggccgcagataaccgcagatattgcaactaatccacccaacccaaaacctctgttccatctgcgccctctgcgaaatctgcggacagctttttttttcgtgcccttcatgtcttcgtggtgaatttcatttaacatttgacaaatatcaaacggcatggtataatgcgttgcgtatttaaggacaaagcaacaccaaaaacagggggagtaaaaaaccgtgtccatccaaaaagaatcgcaggccgcaggcctgccacctatgattaacctcggtctttcagccaaggatgctccccacacccaaacaagcgaaacgaaccgtgcgccaagctaagctggtgcaattcagcaggtgtaatcctgcccggtcaaaggttagccgcccggccggaatgaacatgtacgtataaggaggcaacaaat

SEQ ID NO: 278 - DNA, 36 bp, synthetic construct
  misc_feature 1..36: note = Synthetic Oligonucleotide
  source 1..36: mol_type = other DNA
gctgtaatcaccccacaaatcggaggcttcttcagc

SEQ ID NO: 279 - DNA, 36 bp, synthetic construct
  misc_feature 1..36: note = Synthetic Oligonucleotide
  source 1..36: mol_type = other DNA
gctgtaatcactccacaaatcggaggcttcttcagc

SEQ ID NO: 280 - DNA, 36 bp, synthetic construct
  misc_feature 1..36: note = Synthetic Oligonucleotide
  source 1..36: mol_type = other DNA
gctgaagaagcctccgatttgtggggtgattacagc

SEQ ID NO: 281 - DNA, 36 bp, synthetic construct
  misc_feature 1..36: note = Synthetic Oligonucleotide
  source 1..36: mol_type = other DNA
gctgaagaagcctccgatttgtggagtgattacagc

SEQ ID NO: 282 - DNA, 36 bp, synthetic construct; identical to SEQ ID NO: 278
  misc_feature 1..36: note = Synthetic Oligonucleotide
  source 1..36: mol_type = other DNA

SEQ ID NO: 283 - DNA, 36 bp, synthetic construct; identical to SEQ ID NO: 279
  misc_feature 1..36: note = Synthetic Oligonucleotide
  source 1..36: mol_type = other DNA

SEQ ID NO: 284 - DNA, 36 bp, synthetic construct; identical to SEQ ID NO: 280
  misc_feature 1..36: note = Synthetic Oligonucleotide
  source 1..36: mol_type = other DNA

SEQ ID NO: 285 - DNA, 36 bp, synthetic construct; identical to SEQ ID NO: 281
  misc_feature 1..36: note = Synthetic Oligonucleotide
  source 1..36: mol_type = other DNA

SEQ ID NO: 286 - DNA, 36 bp, synthetic construct
  misc_feature 1..36: note = Synthetic Oligonucleotide
  source 1..36: mol_type = other DNA
gctgtaatcaccccacaaatcgggggcttctccagc

SEQ ID NO: 287 - DNA, 36 bp, synthetic construct
  misc_feature 1..36: note = Synthetic Oligonucleotide
  source 1..36: mol_type = other DNA
gctgcaatcaccccacaaatcgggggcttctccagc

SEQ ID NO: 288 - DNA, 36 bp, synthetic construct
  misc_feature 1..36: note = Synthetic Oligonucleotide
  source 1..36: mol_type = other DNA
gccgtaatcacccctcaaatcgggggcttctccagc

SEQ ID NO: 289 - DNA, 36 bp, synthetic construct
  misc_feature 1..36: note = Synthetic Oligonucleotide
  source 1..36: mol_type = other DNA
ggtgtaatcaccccacaaatcgggggcttctccagc

SEQ ID NO: 290 - DNA, 36 bp, synthetic construct
  misc_feature 1..36: note = Synthetic Oligonucleotide
  source 1..36: mol_type = other DNA
gctggagaagcccccgatttgtggggtgattacagc

SEQ ID NO: 291 - DNA, 36 bp, synthetic construct
  misc_feature 1..36: note = Synthetic Oligonucleotide
  source 1..36: mol_type = other DNA
gctggagaagcccccgatttgtggggtgattgcagc

SEQ ID NO: 292 - DNA, 36 bp, synthetic construct
  misc_feature 1..36: note = Synthetic Oligonucleotide
  source 1..36: mol_type = other DNA
gctggagaagcccccgatttgaggggtgattacggc

SEQ ID NO: 293 - DNA, 36 bp, synthetic construct
  misc_feature 1..36: note = Synthetic Oligonucleotide
  source 1..36: mol_type = other DNA
gctggagaagcccccgatttgtggggtgattacacc

SEQ ID NO: 294 - DNA, 36 bp, synthetic construct; identical to SEQ ID NO: 286
  misc_feature 1..36: note = Synthetic Oligonucleotide
  source 1..36: mol_type = other DNA

SEQ ID NO: 295 - DNA, 36 bp, synthetic construct; identical to SEQ ID NO: 287
  misc_feature 1..36: note = Synthetic Oligonucleotide
  source 1..36: mol_type = other DNA

SEQ ID NO: 296 - DNA, 36 bp, synthetic construct; identical to SEQ ID NO: 288
  misc_feature 1..36: note = Synthetic Oligonucleotide
  source 1..36: mol_type = other DNA

SEQ ID NO: 297 - DNA, 36 bp, synthetic construct; identical to SEQ ID NO: 289
  misc_feature 1..36: note = Synthetic Oligonucleotide
  source 1..36: mol_type = other DNA

SEQ ID NO: 298 - DNA, 36 bp, synthetic construct; identical to SEQ ID NO: 290
  misc_feature 1..36: note = Synthetic Oligonucleotide
  source 1..36: mol_type = other DNA

SEQ ID NO: 299 - DNA, 36 bp, synthetic construct; identical to SEQ ID NO: 291
  misc_feature 1..36: note = Synthetic Oligonucleotide
  source 1..36: mol_type = other DNA

SEQ ID NO: 300 - DNA, 36 bp, synthetic construct; identical to SEQ ID NO: 292
  misc_feature 1..36: note = Synthetic Oligonucleotide
  source 1..36: mol_type = other DNA

SEQ ID NO: 301 - DNA, 36 bp, synthetic construct; identical to SEQ ID NO: 293
  misc_feature 1..36: note = Synthetic Oligonucleotide
  source 1..36: mol_type = other DNA

SEQ ID NO: 302 - DNA, 36 bp, synthetic construct
  misc_feature 1..36: note = Synthetic Oligonucleotide
  source 1..36: mol_type = other DNA
gctgtaatcaccccacaaatcgggggctgctccagc

SEQ ID NO: 303 - DNA, 36 bp, synthetic construct
  misc_feature 1..36: note = Synthetic Oligonucleotide
  source 1..36: mol_type = other DNA
gctggagcagcccccgatttgtggggtgattacagc

SEQ ID NO: 304 - DNA, 36 bp, synthetic construct; identical to SEQ ID NO: 302
  misc_feature 1..36: note = Synthetic Oligonucleotide
  source 1..36: mol_type = other DNA

SEQ ID NO: 305 - DNA, 36 bp, synthetic construct; identical to SEQ ID NO: 303
  misc_feature 1..36: note = Synthetic Oligonucleotide
  source 1..36: mol_type = other DNA

SEQ ID NO: 306 - DNA, 30 bp, synthetic construct
  misc_feature 1..30: note = Synthetic Oligonucleotide
  source 1..30: mol_type = other DNA
gggcattggcttccatctctttgagcacct

SEQ ID NO: 307 - DNA, 30 bp, synthetic construct
  misc_feature 1..30: note = Synthetic Oligonucleotide
  source 1..30: mol_type = other DNA
ggaatgtcgacgatcgcctcgcctatgccg

SEQ ID NO: 308 - DNA, 30 bp, synthetic construct
  misc_feature 1..30: note = Synthetic Oligonucleotide
  source 1..30: mol_type = other DNA
gtaatgcctggcttgtcgacgcatagtctg

SEQ ID NO: 309 - protein, 15 aa, synthetic construct
  REGION 1..15: note = Synthetic Peptide
GSSLQKKLEELELGS

SEQ ID NO: 310 - RNA, 30 nt, synthetic construct
  misc_feature 1..30: note = Synthetic Oligonucleotide
  source 1..30: mol_type = other RNA
gtgccattgatgtgggacaggcagatcaga

SEQ ID NO: 311 - RNA, 31 nt, synthetic construct
  misc_feature 1..31: note = Synthetic Oligonucleotide
  source 1..31: mol_type = other RNA
gttgggcgtgctcttgatgtgggacaggcag

SEQ ID NO: 312 - RNA, 31 nt, synthetic construct
  misc_feature 1..31: note = Synthetic Oligonucleotide
  source 1..31: mol_type = other RNA
ggcctttgatgtgggacaggcagatcagaca

SEQ ID NO: 313 - RNA, 30 nt, synthetic construct
  misc_feature 1..30: note = Synthetic Oligonucleotide
  source 1..30: mol_type = other RNA
gtgccgttgatgtgggacaggcagatcaga

SEQ ID NO: 314 - RNA, 31 nt, synthetic construct
  misc_feature 1..31: note = Synthetic Oligonucleotide
  source 1..31: mol_type = other RNA
gggaacggcagatcagacagcccctggtgca

SEQ ID NO: 315 - RNA, 31 nt, synthetic construct
  misc_feature 1..31: note = Synthetic Oligonucleotide
  source 1..31: mol_type = other RNA
gggattggcagatcagacagcccctggtgca

SEQ ID NO: 316 - RNA, 30 nt, synthetic construct
  misc_feature 1..30: note = Synthetic Oligonucleotide
  source 1..30: mol_type = other RNA
gtgatattgatgtgggacaggcagatcaga

SEQ ID NO: 317 - RNA, 30 nt, synthetic construct
  misc_feature 1..30: note = Synthetic Oligonucleotide
  source 1..30: mol_type = other RNA
gtgctattgatgtgggacaggcagatcaga

SEQ ID NO: 318 - RNA, 30 nt, synthetic construct
  misc_feature 1..30: note = Synthetic Oligonucleotide
  source 1..30: mol_type = other RNA
gtggtattgatgtgggacaggcagatcaga

SEQ ID NO: 319 - RNA, 30 nt, synthetic construct
  misc_feature 1..30: note = Synthetic Oligonucleotide
  source 1..30: mol_type = other RNA
gtgttattgatgtgggacaggcagatcaga

SEQ ID NO: 320 - RNA, 30 nt, synthetic construct
  misc_feature 1..30: note = Synthetic Oligonucleotide
  source 1..30: mol_type = other RNA
gtgattttgatgtgggacaggcagatcaga

SEQ ID NO: 321 - RNA, 30 nt, synthetic construct
  misc_feature 1..30: note = Synthetic Oligonucleotide
  source 1..30: mol_type = other RNA
gtgcttttgatgtgggacaggcagatcaga

SEQ ID NO: 322 - RNA, 30 nt, synthetic construct
  misc_feature 1..30: note = Synthetic Oligonucleotide
  source 1..30: mol_type = other RNA
gtggttttgatgtgggacaggcagatcaga

SEQ ID NO: 323 - RNA, 30 nt, synthetic construct
  misc_feature 1..30: note = Synthetic Oligonucleotide
  source 1..30: mol_type = other RNA
gtgtttttgatgtgggacaggcagatcaga

SEQ ID NO: 324 - RNA, 30 nt, synthetic construct
  misc_feature 1..30: note = Synthetic Oligonucleotide
  source 1..30: mol_type = other RNA
gtgatcttgatgtgggacaggcagatcaga

SEQ ID NO: 325 - RNA, 30 nt, synthetic construct
  misc_feature 1..30: note = Synthetic Oligonucleotide
  source 1..30: mol_type = other RNA
gtgctcttgatgtgggacaggcagatcaga

SEQ ID NO: 326 - RNA, 30 nt, synthetic construct
  misc_feature 1..30: note = Synthetic Oligonucleotide
  source 1..30: mol_type = other RNA
gtggtcttgatgtgggacaggcagatcaga

SEQ ID NO: 327 - RNA, 30 nt, synthetic construct
  misc_feature 1..30: note = Synthetic Oligonucleotide
  source 1..30: mol_type = other RNA
gtgttcttgatgtgggacaggcagatcaga

SEQ ID NO: 328 - RNA, 30 nt, synthetic construct
  misc_feature 1..30: note = Synthetic Oligonucleotide
  source 1..30: mol_type = other RNA
gtgatgttgatgtgggacaggcagatcaga

SEQ ID NO: 329 - RNA, 30 nt, synthetic construct
  misc_feature 1..30: note = Synthetic Oligonucleotide
  source 1..30: mol_type = other RNA
gtgctgttgatgtgggacaggcagatcaga

SEQ ID NO: 330 - RNA, 30 nt, synthetic construct
  misc_feature 1..30: note = Synthetic Oligonucleotide
  source 1..30: mol_type = other RNA
gtggtgttgatgtgggacaggcagatcaga

SEQ ID NO: 331 - RNA, 30 nt, synthetic construct
  misc_feature 1..30: note = Synthetic Oligonucleotide
  source 1..30: mol_type = other RNA
gtgttgttgatgtgggacaggcagatcaga

SEQ ID NO: 332 - RNA, 30 nt, synthetic construct
  misc_feature 1..30: note = Synthetic Oligonucleotide
  source 1..30: mol_type = other RNA
gtgacattgatgtgggacaggcagatcaga

SEQ ID NO: 333 - RNA, 30 nt, synthetic construct
  misc_feature 1..30: note = Synthetic Oligonucleotide
  source 1..30: mol_type = other RNA
gtggcattgatgtgggacaggcagatcaga

SEQ ID NO: 334 - RNA, 30 nt, synthetic construct
  misc_feature 1..30: note = Synthetic Oligonucleotide
  source 1..30: mol_type = other RNA
gtgtcattgatgtgggacaggcagatcaga

SEQ ID NO: 335 - RNA, 30 nt, synthetic construct
  misc_feature 1..30: note = Synthetic Oligonucleotide
  source 1..30: mol_type = other RNA
gtgactttgatgtgggacaggcagatcaga

SEQ ID NO: 336 - RNA, 30 nt, synthetic construct
  misc_feature 1..30: note = Synthetic Oligonucleotide
  source 1..30: mol_type = other RNA
gtgcctttgatgtgggacaggcagatcaga

SEQ ID NO: 337 - RNA, 30 nt, synthetic construct
  misc_feature 1..30: note = Synthetic Oligonucleotide
  source 1..30: mol_type = other RNA
gtggctttgatgtgggacaggcagatcaga

SEQ ID NO: 338 - RNA, 30 nt, synthetic construct
  misc_feature 1..30: note = Synthetic Oligonucleotide
  source 1..30: mol_type = other RNA
gtgtctttgatgtgggacaggcagatcaga

SEQ ID NO: 339 - RNA, 30 nt, synthetic construct
  misc_feature 1..30: note = Synthetic Oligonucleotide
  source 1..30: mol_type = other RNA
gtgaccttgatgtgggacaggcagatcaga

SEQ ID NO: 340 - RNA, 30 nt, synthetic construct
  misc_feature 1..30: note = Synthetic Oligonucleotide
  source 1..30: mol_type = other RNA
gtgcccttgatgtgggacaggcagatcaga

SEQ ID NO: 341 - RNA, 30 nt, synthetic construct
  misc_feature 1..30: note = Synthetic Oligonucleotide
  source 1..30: mol_type = other RNA
gtggccttgatgtgggacaggcagatcaga

SEQ ID NO: 342 - RNA, 30 nt, synthetic construct
  misc_feature 1..30: note = Synthetic Oligonucleotide
  source 1..30: mol_type = other RNA
gtgtccttgatgtgggacaggcagatcaga

SEQ ID NO: 343 - RNA, 30 nt, synthetic construct
  misc_feature 1..30: note = Synthetic Oligonucleotide
  source 1..30: mol_type = other RNA
gtgacgttgatgtgggacaggcagatcaga

SEQ ID NO: 344 - RNA, 30 nt, synthetic construct
  misc_feature 1..30: note = Synthetic Oligonucleotide
  source 1..30: mol_type = other RNA
gtggcgttgatgtgggacaggcagatcaga

SEQ ID NO: 345 - RNA, 30 nt, synthetic construct
  misc_feature 1..30: note = Synthetic Oligonucleotide
  source 1..30: mol_type = other RNA
gtgtcgttgatgtgggacaggcagatcaga

SEQ ID NO: 346 - RNA, 30 nt, synthetic construct
  misc_feature 1..30: note = Synthetic Oligonucleotide
  source 1..30: mol_type = other RNA
gtaatgcctggcttgtcgacgcatagtctg

SEQ ID NO: 347 - RNA, 31 nt, synthetic construct
  misc_feature 1..31: note = Synthetic Oligonucleotide
  source 1..31: mol_type = other RNA
ggtgctagtgatgtgggacaggcagatcaga

SEQ ID NO: 348 - RNA, 31 nt, synthetic construct
  misc_feature 1..31: note = Synthetic Oligonucleotide
  source 1..31: mol_type = other RNA
ggtgctatggatgtgggacaggcagatcaga

SEQ ID NO: 349 - RNA, 31 nt, synthetic construct
  misc_feature 1..31: note = Synthetic Oligonucleotide
  source 1..31: mol_type = other RNA
ggtgctattgatgggggacaggcagatcaga

SEQ ID NO: 350 - RNA, 31 nt, synthetic construct
  misc_feature 1..31: note = Synthetic Oligonucleotide
  source 1..31: mol_type = other RNA
ggtgctagggatgtgggacaggcagatcaga

SEQ ID NO: 351 - RNA, 31 nt, synthetic construct
  misc_feature 1..31: note = Synthetic Oligonucleotide
  source 1..31: mol_type = other RNA
ggtgctagggatgggggacaggcagatcaga

SEQ ID NO: 352 - RNA, 51 nt, synthetic construct
  misc_feature 1..51: note = Synthetic Oligonucleotide
  source 1..51: mol_type = other RNA
gcgccctgtgcggactccttgtcgccttcgtaggtgtggcagcgtcctggg

SEQ ID NO: 353 - RNA, 31 nt, synthetic construct
  misc_feature 1..31: note = Synthetic Oligonucleotide
  source 1..31: mol_type = other RNA
gtattgatgtgggacaggcagatcagacagc

SEQ ID NO: 354 - RNA, 31 nt, synthetic construct
  misc_feature 1..31: note = Synthetic Oligonucleotide
  source 1..31: mol_type = other RNA
ggctattgatgtgggacaggcagatcagaca

SEQ ID NO: 355 - RNA, 31 nt, synthetic construct
  misc_feature 1..31: note = Synthetic Oligonucleotide
  source 1..31: mol_type = other RNA
ggtgctattgatgtgggacaggcagatcaga

SEQ ID NO: 356 - RNA, 31 nt, synthetic construct
  misc_feature 1..31: note = Synthetic Oligonucleotide
  source 1..31: mol_type = other RNA
ggcgtgctattgatgtgggacaggcagatca

SEQ ID NO: 357 - RNA, 31 nt, synthetic construct
  misc_feature 1..31: note = Synthetic Oligonucleotide
  source 1..31: mol_type = other RNA
ggggcgtgctattgatgtgggacaggcagat

SEQ ID NO: 358 - RNA, 31 nt, synthetic construct
  misc_feature 1..31: note = Synthetic Oligonucleotide
  source 1..31: mol_type = other RNA
gttgggcgtgctattgatgtgggacaggcag

SEQ ID NO: 359 - RNA, 31 nt, synthetic construct
  misc_feature 1..31: note = Synthetic Oligonucleotide
  source 1..31: mol_type = other RNA
gtcttgggcgtgctattgatgtgggacaggc

SEQ ID NO: 360 - RNA, 31 nt, synthetic construct
  misc_feature 1..31: note = Synthetic Oligonucleotide
  source 1..31: mol_type = other RNA
gcatcttgggcgtgctattgatgtgggacag

SEQ ID NO: 361 - RNA, 31 nt, synthetic construct
  misc_feature 1..31: note = Synthetic Oligonucleotide
  source 1..31: mol_type = other RNA
gttcatcttgggcgtgctattgatgtgggac

SEQ ID NO: 362 - RNA, 31 nt, synthetic construct
  misc_feature 1..31: note = Synthetic Oligonucleotide
  source 1..31: mol_type = other RNA
gtcttcatcttgggcgtgctattgatgtggg

SEQ ID NO: 363 - RNA, 31 nt, synthetic construct
  misc_feature 1..31: note = Synthetic Oligonucleotide
  source 1..31: mol_type = other RNA
gcttcttcatcttgggcgtgctattgatgtg

SEQ ID NO: 364 - RNA, 31 nt, synthetic construct
  misc_feature 1..31: note = Synthetic Oligonucleotide
  source 1..31: mol_type = other RNA
gaacttcttcatcttgggcgtgctattgatg

SEQ ID NO: 365 - RNA, 31 nt, synthetic construct
  misc_feature 1..31: note = Synthetic Oligonucleotide
  source 1..31: mol_type = other RNA
gtgaacttcttcatcttgggcgtgctattga

SEQ ID NO: 366 - RNA, 31 nt, synthetic construct
  misc_feature 1..31: note = Synthetic Oligonucleotide
  source 1..31: mol_type = other RNA
ggatgaacttcttcatcttgggcgtgctatt

SEQ ID NO: 367 - RNA, 31 nt, synthetic construct
  misc_feature 1..31: note = Synthetic Oligonucleotide
  source 1..31: mol_type = other RNA
ggggatgaacttcttcatcttgggcgtgcta

SEQ ID NO: 368 - RNA, 51 nt, synthetic construct
  misc_feature 1..51: note = Synthetic Oligonucleotide
  source 1..51: mol_type = other RNA
gtattgatgtgggacaggcagatcagacagcccctggtgcagccagctttc

SEQ ID NO: 369 - RNA, 51 nt, synthetic construct
  misc_feature 1..51: note = Synthetic Oligonucleotide
  source 1..51: mol_type = other RNA
ggctattgatgtgggacaggcagatcagacagcccctggtgcagccagctt

SEQ ID NO: 370 - RNA, 51 nt, synthetic construct
  misc_feature 1..51: note = Synthetic Oligonucleotide
  source 1..51: mol_type = other RNA
ggtgctattgatgtgggacaggcagatcagacagcccctggtgcagccagc

SEQ ID NO: 371 - RNA, 51 nt, synthetic construct
  misc_feature 1..51: note = Synthetic Oligonucleotide
  source 1..51: mol_type = other RNA
ggcgtgctattgatgtgggacaggcagatcagacagcccctggtgcagcca

SEQ ID NO: 372 - RNA, 51 nt, synthetic construct
  misc_feature 1..51: note = Synthetic Oligonucleotide
  source 1..51: mol_type = other RNA
ggggcgtgctattgatgtgggacaggcagatcagacagcccctggtgcagc

SEQ ID NO: 373 - RNA, 51 nt, synthetic construct
  misc_feature 1..51: note = Synthetic Oligonucleotide
  source 1..51: mol_type = other RNA
gttgggcgtgctattgatgtgggacaggcagatcagacagcccctggtgca

SEQ ID NO: 374 - RNA, 51 nt, synthetic construct
  misc_feature 1..51: note = Synthetic Oligonucleotide
  source 1..51: mol_type = other RNA
gtcttgggcgtgctattgatgtgggacaggcagatcagacagcccctggtg

SEQ ID NO: 375 - RNA, 31 nt, synthetic construct
  misc_feature 1..31: note = Synthetic Oligonucleotide
  source 1..31: mol_type = other RNA
gggattccacagtccaggtaagactgttgct

SEQ ID NO: 376 - RNA, 31 nt, synthetic construct
  misc_feature 1..31: note = Synthetic Oligonucleotide
  source 1..31: mol_type = other RNA
gaccagaattgattccagagtccaggtaaga

SEQ ID NO: 377 - RNA, 31 nt, synthetic construct
  misc_feature 1..31: note = Synthetic Oligonucleotide
  source 1..31: mol_type = other RNA
gtggcaccataatggattccagagtccaggt

SEQ ID NO: 378 - RNA, 31 nt, synthetic construct
  misc_feature 1..31: note = Synthetic Oligonucleotide
  source 1..31: mol_type = other RNA
gaggagctgtgttagtggcaccagaatggat

SEQ ID NO: 379 - RNA, 31 nt, synthetic construct
  misc_feature 1..31: note = Synthetic Oligonucleotide
  source 1..31: mol_type = other RNA
gtcagagaacgagctgtggtagtggcaccag

SEQ ID NO: 380 - RNA, 31 nt, synthetic construct
  misc_feature 1..31: note = Synthetic Oligonucleotide
  source 1..31: mol_type = other RNA
gctcagagaagtagctgtggtagtggcacca

SEQ ID NO: 381 - RNA, 31 nt, synthetic construct
  misc_feature 1..31: note = Synthetic Oligonucleotide
  source 1..31: mol_type = other RNA
gaccactcagacaaggagctgtggtagtggc

SEQ ID NO: 382 - RNA, 31 nt, synthetic construct
  misc_feature 1..31: note = Synthetic Oligonucleotide
  source 1..31: mol_type = other RNA
gtgtgtctagaatatccaagagacaggtttc

SEQ ID NO: 383 - RNA, 31 nt, synthetic construct
  misc_feature 1..31: note = Synthetic Oligonucleotide
  source 1..31: mol_type = other RNA
ggatcatattcctccacaaaatgattctgaa

SEQ ID NO: 384 - RNA, 31 nt, synthetic construct
  misc_feature 1..31: note = Synthetic Oligonucleotide
  source 1..31: mol_type = other RNA
gtcttgcctactccaccagctccaactacca

SEQ ID NO: 385 - RNA, 31 nt, synthetic construct
  misc_feature 1..31: note = Synthetic Oligonucleotide
  source 1..31: mol_type = other RNA
ggtatcgtcaacgcactcttgcctacgccac

SEQ ID NO: 386 - RNA, 31 nt, synthetic construct
  misc_feature 1..31: note = Synthetic Oligonucleotide
  source 1..31: mol_type = other RNA
gcggaccccgctatgagggcggcggcaagga

SEQ ID NO: 387 - RNA, 31 nt, synthetic construct
  misc_feature 1..31: note = Synthetic Oligonucleotide
  source 1..31: mol_type = other RNA
gatattcctccacaaaatgattctgaattag

SEQ ID NO: 388 - RNA, 31 nt, synthetic construct
  misc_feature 1..31: note = Synthetic Oligonucleotide
  source 1..31: mol_type = other RNA
ggacggacccctcgatgagggcggcggcaag

SEQ ID NO: 389 - RNA, 31 nt, synthetic construct
  misc_feature 1..31: note = Synthetic Oligonucleotide
  source 1..31: mol_type = other RNA
gggaagaagaccgaccccgcgatgagggcgg

SEQ ID NO: 390 - RNA, 31 nt, synthetic construct
  misc_feature 1..31: note = Synthetic Oligonucleotide
  source 1..31: mol_type = other RNA
gggtcgtcctacatgcccttctcatgcatgg

SEQ ID NO: 391 - RNA, 31 nt, synthetic construct
  misc_feature 1..31: note = Synthetic Oligonucleotide
  source 1..31: mol_type = other RNA
gagcgcgggtcttccgacatgcccttctcat

SEQ ID NO: 392 - RNA, 31 nt, synthetic construct
  misc_feature 1..31: note = Synthetic Oligonucleotide
  source 1..31: mol_type = other RNA
gtggttgtagcccgggtcgtccgacatgccc

SEQ ID NO: 393 - RNA, 31 nt, synthetic construct
  misc_feature 1..31: note = Synthetic Oligonucleotide
  source 1..31: mol_type = other RNA
ggttgtagcgctggtcgtccgacatgccctt

SEQ ID NO: 394 - RNA, 31 nt, synthetic construct
  misc_feature 1..31: note = Synthetic Oligonucleotide
  source 1..31: mol_type = other RNA
gggattagctgcattgtcagtgcgcttttcc

SEQ ID NO: 395 - RNA, 31 nt, synthetic construct
  misc_feature 1..31: note = Synthetic Oligonucleotide
  source 1..31: mol_type = other RNA
ggccatctgtgtttgaaatacttctggatta

SEQ ID NO: 396 - RNA, 31 nt, synthetic construct
  misc_feature 1..31: note = Synthetic Oligonucleotide
  source 1..31: mol_type = other RNA
gcagctcgtcttaacctcttgagctgtctca

SEQ ID NO: 397 - RNA, 31 nt, synthetic construct
  misc_feature 1..31: note = Synthetic Oligonucleotide
  source 1..31: mol_type = other RNA
ggtgaacttcttgggttgcttcctcttgaga

SEQ ID NO: 398 - RNA, 31 nt, synthetic construct
  misc_feature 1..31: note = Synthetic Oligonucleotide
  source 1..31: mol_type = other RNA
gttgtagtagagatgcagctggagccatcaa

SEQ ID NO: 399 - RNA, 51 nt, synthetic construct
  misc_feature 1..51: note = Synthetic Oligonucleotide
  source 1..51: mol_type = other RNA
gaaacttggtcttcaggcatggggcagcgctacctgggtcagcttcaggat

SEQ ID NO: 400 - RNA, 31 nt, synthetic construct
  misc_feature 1..31: note = Synthetic Oligonucleotide
  source 1..31: mol_type = other RNA
gtgcgggggcacatcggcaggtcaatggtat

SEQ ID NO: 401 - RNA, 51 nt, synthetic construct
  misc_feature 1..51: note = Synthetic Oligonucleotide
  source 1..51: mol_type = other RNA
gcaactcagtcttgatacatccagttcctttagggccatcaagttccattg

SEQ ID NO: 402 - RNA, 31 nt, synthetic construct
  misc_feature 1..31: note = Synthetic Oligonucleotide
  source 1..31: mol_type = other RNA
gcctcaggacacatggggagcaggttgtctg

SEQ ID NO: 403 - RNA, 31 nt, synthetic construct
  misc_feature 1..31: note = Synthetic Oligonucleotide
  source 1..31: mol_type = other RNA
gattccatagtccaggtaagactgttgctgc

SEQ ID NO: 404 - RNA, 31 nt, synthetic construct
  misc_feature 1..31: note = Synthetic Oligonucleotide
  source 1..31: mol_type = other RNA
gggattccatagtccaggtaagactgttgct

SEQ ID NO: 405 - RNA, 31 nt, synthetic construct
  misc_feature 1..31: note = Synthetic Oligonucleotide
  source 1..31: mol_type = other RNA
gatggattccatagtccaggtaagactgttg

SEQ ID NO: 406 - RNA, 31 nt, synthetic construct
  misc_feature 1..31: note = Synthetic Oligonucleotide
  source 1..31: mol_type = other RNA
ggaatggattccatagtccaggtaagactgt

SEQ ID NO: 407 - RNA, 31 nt, synthetic construct
  misc_feature 1..31: note = Synthetic Oligonucleotide
  source 1..31: mol_type = other RNA
gcagaattgattccagagtccaggtaagact

SEQ ID NO: 408 - RNA, 31 nt, synthetic construct; identical to SEQ ID NO: 376
  misc_feature 1..31: note = Synthetic Oligonucleotide
  source 1..31: mol_type = other RNA

SEQ ID NO: 409 - RNA, 31 nt, synthetic construct
  misc_feature 1..31: note = Synthetic Oligonucleotide
  source 1..31: mol_type = other RNA
ggcaccagaattgattccagagtccaggtaa

SEQ ID NO: 410 - RNA, 31 nt, synthetic construct
  misc_feature 1..31: note = Synthetic Oligonucleotide
  source 1..31: mol_type = other RNA
gtggcaccagaattgattccagagtccaggt

SEQ ID NO: 411 - RNA, 31 nt, synthetic construct
  misc_feature 1..31: note = Synthetic Oligonucleotide
  source 1..31: mol_type = other RNA
ggcaccataatggattccagagtccaggtaa

SEQ ID NO: 412 - RNA, 31 nt, synthetic construct; identical to SEQ ID NO: 377
  misc_feature 1..31: note = Synthetic Oligonucleotide
  source 1..31: mol_type = other RNA

SEQ ID NO: 413 - RNA, 31 nt, synthetic construct
  misc_feature 1..31: note = Synthetic Oligonucleotide
  source 1..31: mol_type = other RNA
gagtggcaccataatggattccagagtccag

SEQ ID NO: 414 - RNA, 31 nt, synthetic construct
  misc_feature 1..31: note = Synthetic Oligonucleotide
  source 1..31: mol_type = other RNA
ggtagtggcaccataatggattccagagtcc

SEQ ID NO: 415 - RNA, 31 nt, synthetic construct
  misc_feature 1..31: note = Synthetic Oligonucleotide
  source 1..31: mol_type = other RNA
ggctgtgttagtggcaccagaatggattcca

SEQ ID NO: 416 - RNA, 31 nt, synthetic construct
  misc_feature 1..31: note = Synthetic Oligonucleotide
  source 1..31: mol_type = other RNA
ggagctgtgttagtggcaccagaatggattc

SEQ ID NO: 417 - RNA, 31 nt, synthetic construct; identical to SEQ ID NO: 378
  misc_feature 1..31: note = Synthetic Oligonucleotide
  source 1..31: mol_type = other RNA

SEQ ID NO: 418 - RNA, 31 nt, synthetic construct
  misc_feature 1..31: note = Synthetic Oligonucleotide
  source 1..31: mol_type = other RNA
ggaaggagctgtgttagtggcaccagaatgg

SEQ ID NO: 419 - RNA, 31 nt, synthetic construct
  misc_feature 1..31: note = Synthetic Oligonucleotide
  source 1..31: mol_type = other RNA
gagagaatgagctgtggtagtggcaccagaa

SEQ ID NO: 420 - RNA, 31 nt, synthetic construct
  misc_feature 1..31: note = Synthetic Oligonucleotide
  source 1..31: mol_type = other RNA
gtcagagaatgagctgtggtagtggcaccag

SEQ ID NO: 421 - RNA, 31 nt, synthetic construct
  misc_feature 1..31: note = Synthetic Oligonucleotide
  source 1..31: mol_type = other RNA
gactcagagaatgagctgtggtagtggcacc

SEQ ID NO: 422 - RNA, 31 nt, synthetic construct
  misc_feature 1..31: note = Synthetic Oligonucleotide
  source 1..31: mol_type = other RNA
gccactcagagaatgagctgtggtagtggca

SEQ ID NO: 423 - RNA, 31 nt, synthetic construct
  misc_feature 1..31: note = Synthetic Oligonucleotide
  source 1..31: mol_type = other RNA
ggagaagtagctgtggtagtggcaccagaat

SEQ ID NO: 424 - RNA, 31 nt, synthetic construct
  misc_feature 1..31: note = Synthetic Oligonucleotide
  source 1..31: mol_type = other RNA
gcagagaagtagctgtggtagtggcaccaga

SEQ ID NO: 425 - RNA, 31 nt, synthetic construct; identical to SEQ ID NO: 380
  misc_feature 1..31: note = Synthetic Oligonucleotide
  source 1..31: mol_type = other RNA

SEQ ID NO: 426 - RNA, 31 nt, synthetic construct
  misc_feature 1..31: note = Synthetic Oligonucleotide
  source 1..31: mol_type = other RNA
gcactcagagaagtagctgtggtagtggcac

SEQ ID NO: 427 - RNA, 31 nt, synthetic construct
  misc_feature 1..31: note = Synthetic Oligonucleotide
  source 1..31: mol_type = other RNA
gctcagataaggagctgtggtagtggcacca

SEQ ID NO: 428 - RNA, 31 nt, synthetic construct
  misc_feature 1..31: note = Synthetic Oligonucleotide
  source 1..31: mol_type = other RNA
gcactcagataaggagctgtggtagtggcac

SEQ ID NO: 429 - RNA, 31 nt, synthetic construct
  misc_feature 1..31: note = Synthetic Oligonucleotide
  source 1..31: mol_type = other RNA
gaccactcagataaggagctgtggtagtggc

SEQ ID NO: 430 - RNA, 31 nt, synthetic construct
  misc_feature 1..31: note = Synthetic Oligonucleotide
  source 1..31: mol_type = other RNA
gttaccactcagataaggagctgtggtagtg

SEQ ID NO: 431 - RNA, 31 nt, synthetic construct; identical to SEQ ID NO: 382
  misc_feature 1..31: note = Synthetic Oligonucleotide
  source 1..31: mol_type = other RNA

SEQ ID NO: 432 - RNA, 31 nt, synthetic construct
  misc_feature 1..31: note = Synthetic Oligonucleotide
  source 1..31: mol_type = other RNA
ggctgtgtctagaatatccaagagacaggtt

SEQ ID NO: 433 - RNA, 31 nt, synthetic construct
  misc_feature 1..31: note = Synthetic Oligonucleotide
  source 1..31: mol_type = other RNA
gctgctgtgtctagaatatccaagagacagg

SEQ ID NO: 434 - RNA, 31 nt, synthetic construct
  misc_feature 1..31: note = Synthetic Oligonucleotide
  source 1..31: mol_type = other RNA
gacctgctgtgtctagaatatccaagagaca

SEQ ID NO: 435 - RNA, 31 nt, synthetic construct
  misc_feature 1..31: note = Synthetic Oligonucleotide
  source 1..31: mol_type = other RNA
gatattcttccacaaaatgattctgaattag

SEQ ID NO: 436 - RNA, 31 nt, synthetic construct
  misc_feature 1..31: note = Synthetic Oligonucleotide
  source 1..31: mol_type = other RNA
gtcatattcttccacaaaatgattctgaatt

SEQ ID NO: 437 - RNA, 31 nt, synthetic construct
  misc_feature 1..31: note = Synthetic Oligonucleotide
  source 1..31: mol_type = other RNA
ggatcatattcttccacaaaatgattctgaa

SEQ ID NO: 438 - RNA, 31 nt, synthetic construct
  misc_feature 1..31: note = Synthetic Oligonucleotide
  source 1..31: mol_type = other RNA
gtggatcatattcttccacaaaatgattctg

SEQ ID NO: 439 - RNA, 31 nt, synthetic construct
  misc_feature 1..31: note = Synthetic Oligonucleotide
  source 1..31: mol_type = other RNA
ggcctactccaccagctccaactaccacaag

SEQ ID NO: 440 - RNA, 31 nt, synthetic construct
  misc_feature 1..31: note = Synthetic Oligonucleotide
  source 1..31: mol_type = other RNA
gttgcctactccaccagctccaactaccaca

SEQ ID NO: 441 - RNA, 31 nt, synthetic construct; identical to SEQ ID NO: 384
  misc_feature 1..31: note = Synthetic Oligonucleotide
  source 1..31: mol_type = other RNA

SEQ ID NO: 442 - RNA, 31 nt, synthetic construct
  misc_feature 1..31: note = Synthetic Oligonucleotide
  source 1..31: mol_type = other RNA
gactcttgcctactccaccagctccaactac

SEQ ID NO: 443 - RNA, 31 nt, synthetic construct
  misc_feature 1..31: note = Synthetic Oligonucleotide
  source 1..31: mol_type = other RNA
gcgtcaatgcactcttgcctacgccaccagc

SEQ ID NO: 444 - RNA, 31 nt, synthetic construct
  misc_feature 1..31: note = Synthetic Oligonucleotide
  source 1..31: mol_type = other RNA
gatcgtcaatgcactcttgcctacgccacca

SEQ ID NO: 445 - RNA, 31 nt, synthetic construct
  misc_feature 1..31: note = Synthetic Oligonucleotide
  source 1..31: mol_type = other RNA
ggtatcgtcaatgcactcttgcctacgccac

SEQ ID NO: 446 - RNA, 31 nt, synthetic construct
  misc_feature 1..31: note = Synthetic Oligonucleotide
  source 1..31: mol_type = other RNA
gctgtatcgtcaatgcactcttgcctacgcc

SEQ ID NO: 447 - RNA, 31 nt, synthetic construct
  misc_feature 1..31: note = Synthetic Oligonucleotide
  source 1..31: mol_type = other RNA
gccccgctatgagggcggcggcaaggagcac

SEQ ID NO: 448 - RNA, 31 nt, synthetic construct
  misc_feature 1..31: note = Synthetic Oligonucleotide
  source 1..31: mol_type = other RNA
ggaccccgctatgagggcggcggcaaggagc

SEQ ID NO: 449 - RNA, 31 nt, synthetic construct; identical to SEQ ID NO: 386
  misc_feature 1..31: note = Synthetic Oligonucleotide
  source 1..31: mol_type = other RNA

SEQ ID NO: 450 - RNA, 31 nt, synthetic construct
  misc_feature 1..31: note = Synthetic Oligonucleotide
  source 1..31: mol_type = other RNA
ggacggaccccgctatgagggcggcggcaag

SEQ ID NO: 451 - RNA, 31 nt, synthetic construct
  misc_feature 1..31: note = Synthetic Oligonucleotide
  source 1..31: mol_type = other RNA
gtgttgctttcggagaggcgcagcatccaca

SEQ ID NO: 452 - RNA, 31 nt, synthetic construct
  misc_feature 1..31: note = Synthetic Oligonucleotide
  source 1..31: mol_type = other RNA
gcatgttgctttcggagaggcgcagcatcca

SEQ ID NO: 453 - RNA, 31 nt, synthetic construct
  misc_feature 1..31: note = Synthetic Oligonucleotide
  source 1..31: mol_type = other RNA
gttcatgttgctttcggagaggcgcagcatc

SEQ ID NO: 454 - RNA, 31 nt, synthetic construct
  misc_feature 1..31: note = Synthetic Oligonucleotide
  source 1..31: mol_type = other RNA
gccttcatgttgctttcggagaggcgcagca

SEQ ID NO: 455 - RNA, 31 nt, synthetic construct
  misc_feature 1..31: note = Synthetic Oligonucleotide
  source 1..31: mol_type = other RNA
ggacccctcgatgagggcggcggcaaggagc

SEQ ID NO: 456 - RNA, 31 nt, synthetic construct
  misc_feature 1..31: note = Synthetic Oligonucleotide
  source 1..31: mol_type = other RNA
gcggacccctcgatgagggcggcggcaagga

SEQ ID NO: 457 - RNA, 31 nt, synthetic construct; identical to SEQ ID NO: 388
  misc_feature 1..31: note = Synthetic Oligonucleotide
  source 1..31: mol_type = other RNA

SEQ ID NO: 458 - RNA, 31 nt, synthetic construct
  misc_feature 1..31: note = Synthetic Oligonucleotide
  source 1..31: mol_type = other RNA
gaagacggacccctcgatgagggcggcggca

SEQ ID NO: 459 - RNA, 31 nt, synthetic construct
  misc_feature 1..31: note = Synthetic Oligonucleotide
  source 1..31: mol_type = other RNA
ggaagactgaccccgcgatgagggcggcggc

SEQ ID NO: 460 - RNA, 31 nt, synthetic construct
  misc_feature 1..31: note = Synthetic Oligonucleotide
  source 1..31: mol_type = other RNA
gaagaagactgaccccgcgatgagggcggcg

SEQ ID NO: 461 - RNA, 31 nt, synthetic construct
  misc_feature 1..31: note = Synthetic Oligonucleotide
  source 1..31: mol_type = other RNA
gggaagaagactgaccccgcgatgagggcgg

SEQ ID NO: 462 - RNA, 31 nt, synthetic construct
  misc_feature 1..31: note = Synthetic Oligonucleotide
  source 1..31: mol_type = other RNA
gcaggaagaagactgaccccgcgatgagggc

SEQ ID NO: 463 - RNA, 31 nt, synthetic construct
  misc_feature 1..31: note = Synthetic Oligonucleotide
  source 1..31: mol_type = other RNA
gtcgtcctacatgcccttctcatgcatggac

SEQ ID NO: 464 - RNA, 31 nt, synthetic construct; identical to SEQ ID NO: 390
  misc_feature 1..31: note = Synthetic Oligonucleotide
  source 1..31: mol_type = other RNA

SEQ ID NO: 465 - RNA, 31 nt, synthetic construct
  misc_feature 1..31: note = Synthetic Oligonucleotide
  source 1..31: mol_type = other RNA
gcgggtcgtcctacatgcccttctcatgcat

SEQ ID NO: 466 - RNA, 31 nt, synthetic construct
  misc_feature 1..31: note = Synthetic Oligonucleotide
  source 1..31: mol_type = other RNA
gcgcgggtcgtcctacatgcccttctcatgc

SEQ ID NO: 467 - RNA, 31 nt, synthetic construct
  misc_feature 1..31: note = Synthetic Oligonucleotide
  source 1..31: mol_type = other RNA
gcgggtcttccgacatgcccttctcatgcat

SEQ ID NO: 468 - RNA, 31 nt, synthetic construct
  misc_feature 1..31: note = Synthetic Oligonucleotide
  source 1..31: mol_type = other RNA
gcgcgggtcttccgacatgcccttctcatgc

SEQ ID NO: 469 - RNA, 31 nt, synthetic construct; identical to SEQ ID NO: 391
  misc_feature 1..31: note = Synthetic Oligonucleotide
  source 1..31: mol_type = other RNA

SEQ ID NO: 470 - RNA, 31 nt, synthetic construct
  misc_feature 1..31: note = Synthetic Oligonucleotide
  source 1..31: mol_type = other RNA
ggtagcgcgggtcttccgacatgcccttctc

SEQ ID NO: 471 - RNA, 31 nt, synthetic construct
  misc_feature 1..31: note = Synthetic Oligonucleotide
  source 1..31: mol_type = other RNA
gtgtagctcgggtcgtccgacatgcccttct

SEQ ID NO: 472 - RNA, 31 nt, synthetic construct
  misc_feature 1..31: note = Synthetic Oligonucleotide
  source 1..31: mol_type = other RNA
ggttgtagctcgggtcgtccgacatgccctt

SEQ ID NO: 473 - RNA, 31 nt, synthetic construct
  misc_feature 1..31: note = Synthetic Oligonucleotide
  source 1..31: mol_type = other RNA
gtggttgtagctcgggtcgtccgacatgccc

SEQ ID NO: 474 - RNA, 31 nt, synthetic construct
  misc_feature 1..31: note = Synthetic Oligonucleotide
  source 1..31: mol_type = other RNA
gtctggttgtagctcgggtcgtccgacatgc

SEQ ID NO: 475 - RNA, 31 nt, synthetic construct
  misc_feature 1..31: note = Synthetic Oligonucleotide
  source 1..31: mol_type = other RNA
gtagcgctggtcgtccgacatgcccttctca

SEQ ID NO: 476 - RNA, 31 nt, synthetic construct
  misc_feature 1..31: note = Synthetic Oligonucleotide
  source 1..31: mol_type = other RNA
gtgtagcgctggtcgtccgacatgcccttct

SEQ ID NO: 477 - RNA, 31 nt, synthetic construct; identical to SEQ ID NO: 393
  misc_feature 1..31: note = Synthetic Oligonucleotide
  source 1..31: mol_type = other RNA

SEQ ID NO: 478 - RNA, 31 nt, synthetic construct
  misc_feature 1..31: note = Synthetic Oligonucleotide
  source 1..31: mol_type = other RNA
gtggttgtagcgctggtcgtccgacatgccc

SEQ ID NO: 479 - RNA, 31 nt, synthetic construct
  misc_feature 1..31: note = Synthetic Oligonucleotide
  source 1..31: mol_type = other RNA
gattccacagtccaggtaagactgttgctgc

SEQ ID NO: 480 - RNA, 31 nt, synthetic construct; identical to SEQ ID NO: 375
  misc_feature 1..31: note = Synthetic Oligonucleotide
  source 1..31: mol_type = other RNA

SEQ ID NO: 481 - RNA, 31 nt, synthetic construct
  misc_feature 1..31: note = Synthetic Oligonucleotide
  source 1..31: mol_type = other RNA
gatggattccacagtccaggtaagactgttg

SEQ ID NO: 482 - RNA, 31 nt, synthetic construct
  misc_feature 1..31: note = Synthetic Oligonucleotide
  source 1..31: mol_type = other RNA
ggaatggattccacagtccaggtaagactgt

SEQ ID NO: 483 - RNA, 31 nt, synthetic construct
  misc_feature 1..31: note = Synthetic Oligonucleotide
  source 1..31: mol_type = other RNA
gcagaatcgattccagagtccaggtaagact

SEQ ID NO: 484 - RNA, 31 nt, synthetic construct
  misc_feature 1..31: note = Synthetic Oligonucleotide
  source 1..31: mol_type = other RNA
gaccagaatcgattccagagtccaggtaaga

SEQ ID NO: 485 - RNA, 31 nt, synthetic construct
  misc_feature 1..31: note = Synthetic Oligonucleotide
  source 1..31: mol_type = other RNA
ggcaccagaatcgattccagagtccaggtaa

SEQ ID NO: 486 - RNA, 31 nt, synthetic construct
  misc_feature 1..31: note = Synthetic Oligonucleotide
  source 1..31: mol_type = other RNA
gtggcaccagaatcgattccagagtccaggt

SEQ ID NO: 487 - RNA, 31 nt, synthetic construct
  misc_feature 1..31: note = Synthetic Oligonucleotide
  source 1..31: mol_type = other RNA
ggcaccacaatggattccagagtccaggtaa

SEQ ID NO: 488 - RNA, 31 nt, synthetic construct
  misc_feature 1..31: note = Synthetic Oligonucleotide
  source 1..31: mol_type = other RNA
gtggcaccacaatggattccagagtccaggt

SEQ ID NO: 489 - RNA, 31 nt, synthetic construct
  misc_feature 1..31: note = Synthetic Oligonucleotide
  source 1..31: mol_type = other RNA
gagtggcaccacaatggattccagagtccag

SEQ ID NO: 490 - RNA, 31 nt, synthetic construct
  misc_feature 1..31: note = Synthetic Oligonucleotide
  source 1..31: mol_type = other RNA
ggtagtggcaccacaatggattccagagtcc

SEQ ID NO: 491 - RNA, 31 nt, synthetic construct
  misc_feature 1..31: note = Synthetic Oligonucleotide
  source 1..31: mol_type = other RNA
ggctgtgctagtggcaccagaatggattcca

SEQ ID NO: 492 - RNA, 31 nt, synthetic construct
  misc_feature 1..31: note = Synthetic Oligonucleotide
  source 1..31: mol_type = other RNA
ggagctgtgctagtggcaccagaatggattc

SEQ ID NO: 493 - RNA, 31 nt, synthetic construct
  misc_feature 1..31: note = Synthetic Oligonucleotide
  source 1..31: mol_type = other RNA
gaggagctgtgctagtggcaccagaatggat

SEQ ID NO: 494 - RNA, 31 nt, synthetic construct
  misc_feature 1..31: note = Synthetic Oligonucleotide
  source 1..31: mol_type = other RNA
ggaaggagctgtgctagtggcaccagaatgg

SEQ ID NO: 495 - RNA, 31 nt, synthetic construct
  misc_feature 1..31: note = Synthetic Oligonucleotide
  source 1..31: mol_type = other RNA
gagagaacgagctgtggtagtggcaccagaa

SEQ ID NO: 496 - RNA, 31 nt, synthetic construct; identical to SEQ ID NO: 379
  misc_feature 1..31: note = Synthetic Oligonucleotide
  source 1..31: mol_type = other RNA

SEQ ID NO: 497 - RNA, 31 nt, synthetic construct
  misc_feature 1..31: note = Synthetic Oligonucleotide
  source 1..31: mol_type = other RNA
gactcagagaacgagctgtggtagtggcacc

SEQ ID NO: 498 - RNA, 31 nt, synthetic construct
  misc_feature 1..31: note = Synthetic Oligonucleotide
  source 1..31: mol_type = other RNA
gccactcagagaacgagctgtggtagtggca

SEQ ID NO: 499 - RNA, 31 nt, synthetic construct
  misc_feature 1..31: note = Synthetic Oligonucleotide
  source 1..31: mol_type = other RNA
ggagaagcagctgtggtagtggcaccagaat

SEQ ID NO: 500 - RNA, 31 nt, synthetic construct
  misc_feature 1..31: note = Synthetic Oligonucleotide
  source 1..31: mol_type = other RNA
gcagagaagcagctgtggtagtggcaccaga

SEQ ID NO: 501 - RNA, 31 nt, synthetic construct
  misc_feature 1..31: note = Synthetic Oligonucleotide
  source 1..31: mol_type = other RNA
gctcagagaagcagctgtggtagtggcacca

SEQ ID NO: 502 - RNA, 31 nt, synthetic construct
  misc_feature 1..31: note = Synthetic Oligonucleotide
  source 1..31: mol_type = other RNA
gcactcagagaagcagctgtggtagtggcac

SEQ ID NO: 503 - RNA, 31 nt, synthetic construct
  misc_feature 1..31: note = Synthetic Oligonucleotide
  source 1..31: mol_type = other RNA
gctcagacaaggagctgtggtagtggcacca

SEQ ID NO: 504 - RNA, 31 nt, synthetic construct
  misc_feature 1..31: note = Synthetic Oligonucleotide
  source 1..31: mol_type = other RNA
gcactcagacaaggagctgtggtagtggcac

SEQ ID NO: 505 - RNA, 31 nt, synthetic construct; identical to SEQ ID NO: 381
  misc_feature 1..31: note = Synthetic Oligonucleotide
  source 1..31: mol_type = other RNA

SEQ ID NO: 506 - RNA, 31 nt, synthetic construct
  misc_feature 1..31: note = Synthetic Oligonucleotide
  source 1..31: mol_type = other RNA
gttaccactcagacaaggagctgtggtagtg

SEQ ID NO: 507 - RNA, 31 nt, synthetic construct
  misc_feature 1..31: note = Synthetic Oligonucleotide
  source 1..31: mol_type = other RNA
gtgtgtccagaatatccaagagacaggtttc

SEQ ID NO: 508 - RNA, 31 nt, synthetic construct
  misc_feature 1..31: note = Synthetic Oligonucleotide
  source 1..31: mol_type = other RNA
ggctgtgtccagaatatccaagagacaggtt

SEQ ID NO: 509 - RNA, 31 nt, synthetic construct
  misc_feature 1..31: note = Synthetic Oligonucleotide
  source 1..31: mol_type = other RNA
gctgctgtgtccagaatatccaagagacagg

SEQ ID NO: 510 - RNA, 31 nt, synthetic construct
  misc_feature 1..31: note = Synthetic Oligonucleotide
  source 1..31: mol_type = other RNA
gacctgctgtgtccagaatatccaagagaca

SEQ ID NO: 511 - RNA, 31 nt, synthetic construct; identical to SEQ ID NO: 387
  misc_feature 1..31: note = Synthetic Oligonucleotide
  source 1..31: mol_type = other RNA

SEQ ID NO: 512 - RNA, 31 nt, synthetic construct
  misc_feature 1..31: note = Synthetic Oligonucleotide
  source 1..31: mol_type = other RNA
gtcatattcctccacaaaatgattctgaatt

SEQ ID NO: 513 - RNA, 31 nt, synthetic construct; identical to SEQ ID NO: 383
  misc_feature 1..31: note = Synthetic Oligonucleotide
  source 1..31: mol_type = other RNA

SEQ ID NO: 514 - RNA, 31 nt, synthetic construct
  misc_feature 1..31: note = Synthetic Oligonucleotide
  source 1..31: mol_type = other RNA
gtggatcatattcctccacaaaatgattctg

SEQ ID NO: 515 - RNA, 31 nt, synthetic construct
  misc_feature 1..31: note = Synthetic Oligonucleotide
  source 1..31: mol_type = other RNA
ggcctaccccaccagctccaactaccacaag

SEQ ID NO: 516 - RNA, 31 nt, synthetic construct
  misc_feature 1..31: note = Synthetic Oligonucleotide
  source 1..31: mol_type = other RNA
gttgcctaccccaccagctccaactaccaca

SEQ ID NO: 517 - RNA, 31 nt, synthetic construct
  misc_feature 1..31: note = Synthetic Oligonucleotide
  source 1..31: mol_type = other RNA
gtcttgcctaccccaccagctccaactacca

SEQ ID NO: 518 - RNA, 31 nt, synthetic construct
  misc_feature 1..31: note = Synthetic Oligonucleotide
  source 1..31: mol_type = other RNA
gactcttgcctaccccaccagctccaactac

SEQ ID NO: 519 - RNA, 31 nt, synthetic construct
  misc_feature 1..31: note = Synthetic Oligonucleotide
  source 1..31: mol_type = other RNA
gcgtcaacgcactcttgcctacgccaccagc

SEQ ID NO: 520 - RNA, 31 nt, synthetic construct
  misc_feature 1..31: note = Synthetic Oligonucleotide
  source 1..31: mol_type = other RNA
gatcgtcaacgcactcttgcctacgccacca

SEQ ID NO: 521 - RNA, 31 nt, synthetic construct; identical to SEQ ID NO: 385
  misc_feature 1..31: note = Synthetic Oligonucleotide
  source 1..31: mol_type = other RNA

SEQ ID NO: 522 - RNA, 31 nt, synthetic construct
  misc_feature 1..31: note = Synthetic Oligonucleotide
  source 1..31: mol_type = other RNA
gctgtatcgtcaacgcactcttgcctacgcc

SEQ ID NO: 523 - RNA, 31 nt, synthetic construct
  misc_feature 1..31: note = Synthetic Oligonucleotide
  source 1..31: mol_type = other RNA
gccccgccatgagggcggcggcaaggagcac

SEQ ID NO: 524 - RNA, 31 nt, synthetic construct
  misc_feature 1..31: note = Synthetic Oligonucleotide
  source 1..31: mol_type = other RNA
ggaccccgccatgagggcggcggcaaggagc

SEQ ID NO: 525 - RNA, 31 nt, synthetic construct
  misc_feature 1..31: note = Synthetic Oligonucleotide
  source 1..31: mol_type = other RNA
gcggaccccgccatgagggcggcggcaagga

SEQ ID NO: 526 - RNA, 31 nt, synthetic construct
  misc_feature 1..31: note = Synthetic Oligonucleotide
  source 1..31: mol_type = other RNA
ggacggaccccgccatgagggcggcggcaag

SEQ ID NO: 527 - RNA, 31 nt, synthetic construct
  misc_feature 1..31: note = Synthetic Oligonucleotide
  source 1..31: mol_type = other RNA
gtgttgccttcggagaggcgcagcatccaca

SEQ ID NO: 528 - RNA, 31 nt, synthetic construct
  misc_feature 1..31: note = Synthetic Oligonucleotide
  source 1..31: mol_type = other RNA
gcatgttgccttcggagaggcgcagcatcca

SEQ ID NO: 529 - RNA, 31 nt, synthetic construct
  misc_feature 1..31: note = Synthetic Oligonucleotide
  source 1..31: mol_type = other RNA
gttcatgttgccttcggagaggcgcagcatc

SEQ ID NO: 530 - RNA, 31 nt, synthetic construct
  misc_feature 1..31: note = Synthetic Oligonucleotide
  source 1..31: mol_type = other RNA
gccttcatgttgccttcggagaggcgcagca

SEQ ID NO: 531 - RNA, 31 nt, synthetic construct
  misc_feature 1..31: note = Synthetic Oligonucleotide
  source 1..31: mol_type = other RNA
ggaccccccgatgagggcggcggcaaggagc

SEQ ID NO: 532 - RNA, 31 nt, synthetic construct
  misc_feature 1..31: note = Synthetic Oligonucleotide
  source 1..31: mol_type = other RNA
gcggaccccccgatgagggcggcggcaagga

SEQ ID NO: 533 - RNA, 31 nt, synthetic construct
  misc_feature 1..31: note = Synthetic Oligonucleotide
  source 1..31: mol_type = other RNA
ggacggaccccccgatgagggcggcggcaag

SEQ ID NO: 534 - RNA, 31 nt, synthetic construct
  misc_feature 1..31: note = Synthetic Oligonucleotide
  source 1..31: mol_type = other RNA
gaagacggaccccccgatgagggcggcggca

SEQ ID NO: 535 - RNA, 31 nt, synthetic construct
  misc_feature 1..31: note = Synthetic Oligonucleotide
  source 1..31: mol_type = other RNA
ggaagaccgaccccgcgatgagggcggcggc

SEQ ID NO: 536 - RNA, 31 nt, synthetic construct
  misc_feature 1..31: note = Synthetic Oligonucleotide
  source 1..31: mol_type = other RNA
gaagaagaccgaccccgcgatgagggcggcg

SEQ ID NO: 537 - RNA, 31 nt, synthetic construct; identical to SEQ ID NO: 389
  misc_feature 1..31: note = Synthetic Oligonucleotide
  source 1..31: mol_type = other RNA

SEQ ID NO: 538 - RNA, 31 nt, synthetic construct
  misc_feature 1..31: note = Synthetic Oligonucleotide
  source 1..31: mol_type = other RNA
gcaggaagaagaccgaccccgcgatgagggc

SEQ ID NO: 539 - RNA, 31 nt, synthetic construct
  misc_feature 1..31: note = Synthetic Oligonucleotide
  source 1..31: mol_type = other RNA
gtcgtcccacatgcccttctcatgcatggac

SEQ ID NO: 540 - RNA, 31 nt, synthetic construct
  misc_feature 1..31: note = Synthetic Oligonucleotide
  source 1..31: mol_type = other RNA
gggtcgtcccacatgcccttctcatgcatgg

SEQ ID NO: 541 - RNA, 31 nt, synthetic construct
  misc_feature 1..31: note = Synthetic Oligonucleotide
  source 1..31: mol_type = other RNA
gcgggtcgtcccacatgcccttctcatgcat

SEQ ID NO: 542 - RNA, 31 nt, synthetic construct
  misc_feature 1..31: note = Synthetic Oligonucleotide
  source 1..31: mol_type = other RNA
gcgcgggtcgtcccacatgcccttctcatgc

SEQ ID NO: 543 - RNA, 31 nt, synthetic construct
  misc_feature 1..31: note = Synthetic Oligonucleotide
  source 1..31: mol_type = other RNA
gcgggtcctccgacatgcccttctcatgcat

SEQ ID NO: 544 - RNA, 31 nt, synthetic construct
  misc_feature 1..31: note = Synthetic Oligonucleotide
  source 1..31: mol_type = other RNA
gcgcgggtcctccgacatgcccttctcatgc

SEQ ID NO: 545 - RNA, 31 nt, synthetic construct
  misc_feature 1..31: note = Synthetic Oligonucleotide
  source 1..31: mol_type = other RNA
gagcgcgggtcctccgacatgcccttctcat

SEQ ID NO: 546 - RNA, 31 nt, synthetic construct
  misc_feature 1..31: note = Synthetic Oligonucleotide
  source 1..31: mol_type = other RNA
ggtagcgcgggtcctccgacatgcccttctc

SEQ ID NO: 547 - RNA, 31 nt, synthetic construct
  misc_feature 1..31: note = Synthetic Oligonucleotide
  source 1..31: mol_type = other RNA
gtgtagcccgggtcgtccgacatgcccttct

SEQ ID NO: 548 - RNA, 31 nt, synthetic construct
  misc_feature 1..31: note = Synthetic Oligonucleotide
  source 1..31: mol_type = other RNA
ggttgtagcccgggtcgtccgacatgccctt

SEQ ID NO: 549 - RNA, 31 nt, synthetic construct; identical to SEQ ID NO: 392
  misc_feature 1..31: note = Synthetic Oligonucleotide
  source 1..31: mol_type = other RNA

SEQ ID NO: 550 - RNA, 31 nt, synthetic construct
  misc_feature 1..31: note = Synthetic Oligonucleotide
  source 1..31: mol_type = other RNA
gtctggttgtagcccgggtcgtccgacatgc

SEQ ID NO: 551 - RNA, 31 nt, synthetic construct
  misc_feature 1..31: note = Synthetic Oligonucleotide
  source 1..31: mol_type = other RNA
gtagcgccggtcgtccgacatgcccttctca

SEQ ID NO: 552 - RNA, 31 nt, synthetic construct
  misc_feature 1..31: note = Synthetic Oligonucleotide
  source 1..31: mol_type = other RNA
gtgtagcgccggtcgtccgacatgcccttct

SEQ ID NO: 553 - RNA, 31 nt, synthetic construct
  misc_feature 1..31: note = Synthetic Oligonucleotide
  source 1..31: mol_type = other RNA
ggttgtagcgccggtcgtccgacatgccctt

SEQ ID NO: 554 - RNA, 31 nt, synthetic construct
  misc_feature 1..31: note = Synthetic Oligonucleotide
  source 1..31: mol_type = other RNA
gtggttgtagcgccggtcgtccgacatgccc

SEQ ID NO: 555 - RNA, 31 nt, synthetic construct
  misc_feature 1..31: note = Synthetic Oligonucleotide
  source 1..31: mol_type = other RNA
gtgcattgtcagtgcgcttttcccaacacca

SEQ ID NO: 556 - RNA, 31 nt, synthetic construct
  misc_feature 1..31: note = Synthetic Oligonucleotide
  source 1..31: mol_type = other RNA
ggctgcattgtcagtgcgcttttcccaacac

SEQ ID NO: 557 - RNA, 31 nt, synthetic construct
  misc_feature 1..31: note = Synthetic Oligonucleotide
  source 1..31: mol_type = other RNA
gtagctgcattgtcagtgcgcttttcccaac

SEQ ID NO: 558 - RNA, 31 nt, synthetic construct
  misc_feature 1..31: note = Synthetic Oligonucleotide
  source 1..31: mol_type = other RNA
gattagctgcattgtcagtgcgcttttccca

SEQ ID NO: 559 - RNA, 31 nt, synthetic construct; identical to SEQ ID NO: 394
  misc_feature 1..31: note = Synthetic Oligonucleotide
  source 1..31: mol_type = other RNA

SEQ ID NO: 560 - RNA, 31 nt, synthetic construct
  misc_feature 1..31: note = Synthetic Oligonucleotide
  source 1..31: mol_type = other RNA
gtgcttgaaatacttctggattaaatattgt

SEQ ID NO: 561 - RNA, 31 nt, synthetic construct
  misc_feature 1..31: note = Synthetic Oligonucleotide
  source 1..31: mol_type = other RNA
gtgtgcttgaaatacttctggattaaatatt

SEQ ID NO: 562 - RNA, 31 nt, synthetic construct
  misc_feature 1..31: note = Synthetic Oligonucleotide
  source 1..31: mol_type = other RNA
gtctgtgcttgaaatacttctggattaaata

SEQ ID NO: 563 - RNA, 31 nt, synthetic construct
  misc_feature 1..31: note = Synthetic Oligonucleotide
  source 1..31: mol_type = other RNA
gcatctgtgcttgaaatacttctggattaaa

SEQ ID NO: 564 - RNA, 31 nt, synthetic construct
  misc_feature 1..31: note = Synthetic Oligonucleotide
  source 1..31: mol_type = other RNA
ggccatctgtgcttgaaatacttctggatta

SEQ ID NO: 565 - RNA, 31 nt, synthetic construct
  misc_feature 1..31: note = Synthetic Oligonucleotide
  source 1..31: mol_type = other RNA
gctcaacctcttgagctgtctcagtcgcatg

SEQ ID NO: 566 - RNA, 31 nt, synthetic construct
  misc_feature 1..31: note = Synthetic Oligonucleotide
  source 1..31: mol_type = other RNA
ggtctcaacctcttgagctgtctcagtcgca

SEQ ID NO: 567 - RNA, 31 nt, synthetic construct
  misc_feature 1..31: note = Synthetic Oligonucleotide
  source 1..31: mol_type = other RNA
gtcgtctcaacctcttgagctgtctcagtcg

SEQ ID NO: 568 - RNA, 31 nt, synthetic construct
  misc_feature 1..31: note = Synthetic Oligonucleotide
  source 1..31: mol_type = other RNA
ggctcgtctcaacctcttgagctgtctcagt

SEQ ID NO: 569 - RNA, 31 nt, synthetic construct
  misc_feature 1..31: note = Synthetic Oligonucleotide
  source 1..31: mol_type = other RNA
gcagctcgtctcaacctcttgagctgtctca

SEQ ID NO: 570 - RNA, 31 nt, synthetic construct
  misc_feature 1..31: note = Synthetic Oligonucleotide
  source 1..31: mol_type = other RNA
gacctcttgggttgcttcctcttgagagagc

SEQ ID NO: 571 - RNA, 31 nt, synthetic construct
  misc_feature 1..31: note = Synthetic Oligonucleotide
  source 1..31: mol_type = other RNA
ggaacctcttgggttgcttcctcttgagaga

SEQ ID NO: 572 - RNA, 31 nt, synthetic construct
  misc_feature 1..31: note = Synthetic Oligonucleotide
  source 1..31: mol_type = other RNA
ggtgaacctcttgggttgcttcctcttgaga

SEQ ID NO: 573 - RNA, 31 nt, synthetic construct
  misc_feature 1..31: note = Synthetic Oligonucleotide
  source 1..31: mol_type = other RNA
gcggtgaacctcttgggttgcttcctcttga

SEQ ID NO: 574 - RNA, 31 nt, synthetic construct
  misc_feature 1..31: note = Synthetic Oligonucleotide
  source 1..31: mol_type = other RNA
gcacggtgaacctcttgggttgcttcctctt

SEQ ID NO: 575 - RNA, 31 nt, synthetic construct
  misc_feature 1..31: note = Synthetic Oligonucleotide
  source 1..31: mol_type = other RNA
gagcagagatgcagctggagccatcaaacac

SEQ ID NO: 576 - RNA, 31 nt, synthetic construct
  misc_feature 1..31: note = Synthetic Oligonucleotide
  source 1..31: mol_type = other RNA
ggtagcagagatgcagctggagccatcaaac

SEQ ID NO: 577 - RNA, 31 nt, synthetic construct
  misc_feature 1..31: note = Synthetic Oligonucleotide
  source 1..31: mol_type = other RNA
gttgtagcagagatgcagctggagccatcaa

SEQ ID NO: 578 - RNA, 31 nt, synthetic construct
  misc_feature 1..31: note = Synthetic Oligonucleotide
  source 1..31: mol_type = other RNA
gtattgtagcagagatgcagctggagccatc

SEQ ID NO: 579 - RNA, 31 nt, synthetic construct
  misc_feature 1..31: note = Synthetic Oligonucleotide
  source 1..31: mol_type = other RNA
gactattgtagcagagatgcagctggagcca

SEQ ID NO: 580 - RNA, 31 nt, synthetic construct
  misc_feature 1..31: note = Synthetic Oligonucleotide
  source 1..31: mol_type = other RNA
gtgtattgtcagtgcgcttttcccaacacca

SEQ ID NO: 581 - RNA, 31 nt, synthetic construct
  misc_feature 1..31: note = Synthetic Oligonucleotide
  source 1..31: mol_type = other RNA
ggctgtattgtcagtgcgcttttcccaacac

SEQ ID NO: 582 - RNA, 31 nt, synthetic construct
  misc_feature 1..31: note = Synthetic Oligonucleotide
  source 1..31: mol_type = other RNA
gtagctgtattgtcagtgcgcttttcccaac

SEQ ID NO: 583 - RNA, 31 nt, synthetic construct
  misc_feature 1..31: note = Synthetic Oligonucleotide
  source 1..31: mol_type = other RNA
gattagctgtattgtcagtgcgcttttccca

SEQ ID NO: 584 - RNA, 31 nt, synthetic construct
  misc_feature 1..31: note = Synthetic Oligonucleotide
  source 1..31: mol_type = other RNA
gggattagctgtattgtcagtgcgcttttcc

SEQ ID NO: 585 - RNA, 31 nt, synthetic construct
  misc_feature 1..31: note = Synthetic Oligonucleotide
  source 1..31: mol_type = other RNA
gtgtttgaaatacttctggattaaatattgt

SEQ ID NO: 586 - RNA, 31 nt, synthetic construct
  misc_feature 1..31: note = Synthetic Oligonucleotide
  source 1..31: mol_type = other RNA
gtgtgtttgaaatacttctggattaaatatt

SEQ ID NO: 587 - RNA, 31 nt, synthetic construct
  misc_feature 1..31: note = Synthetic Oligonucleotide
  source 1..31: mol_type = other RNA
gtctgtgtttgaaatacttctggattaaata

SEQ ID NO: 588 - RNA, 31 nt, synthetic construct
  misc_feature 1..31: note = Synthetic Oligonucleotide
  source 1..31: mol_type = other RNA
gcatctgtgtttgaaatacttctggattaaa

SEQ ID NO: 589 - RNA, 31 nt, synthetic construct; identical to SEQ ID NO: 395
  misc_feature 1..31: note = Synthetic Oligonucleotide
  source 1..31: mol_type = other RNA

SEQ ID NO: 590 - RNA, 31 nt, synthetic construct
  misc_feature 1..31: note = Synthetic Oligonucleotide
  source 1..31: mol_type = other RNA
gcttaacctcttgagctgtctcagtcgcatg

SEQ ID NO: 591 - RNA, 31 nt, synthetic construct
  misc_feature 1..31: note = Synthetic Oligonucleotide
  source 1..31: mol_type = other RNA
ggtcttaacctcttgagctgtctcagtcgca

SEQ ID NO: 592 - RNA, 31 nt, synthetic construct
  misc_feature 1..31: note = Synthetic Oligonucleotide
  source 1..31: mol_type = other RNA
gtcgtcttaacctcttgagctgtctcagtcg

SEQ ID NO: 593 - RNA, 31 nt, synthetic construct
  misc_feature 1..31: note = Synthetic Oligonucleotide
  source 1..31: mol_type = other RNA
ggctcgtcttaacctcttgagctgtctcagt

SEQ ID NO: 594 - RNA, 31 nt, synthetic construct; identical to SEQ ID NO: 396
  misc_feature 1..31: note = Synthetic Oligonucleotide
  source 1..31: mol_type = other RNA

SEQ ID NO: 595 - RNA, 31 nt, synthetic construct
  misc_feature 1..31: note = Synthetic Oligonucleotide
  source 1..31: mol_type = other RNA
gacttcttgggttgcttcctcttgagagagc

SEQ ID NO: 596 - RNA, 31 nt, synthetic construct
  misc_feature 1..31: note = Synthetic Oligonucleotide
  source 1..31: mol_type = other RNA
ggaacttcttgggttgcttcctcttgagaga

SEQ ID NO: 597 - RNA, 31 nt, synthetic construct; identical to SEQ ID NO: 397
  misc_feature 1..31: note = Synthetic Oligonucleotide
  source 1..31: mol_type = other RNA

SEQ ID NO: 598 - RNA, 31 nt, synthetic construct
  misc_feature 1..31: note = Synthetic Oligonucleotide
  source 1..31: mol_type = other RNA
gcggtgaacttcttgggttgcttcctcttga

SEQ ID NO: 599 - RNA, 31 nt, synthetic construct
  misc_feature 1..31: note = Synthetic Oligonucleotide
  source 1..31: mol_type = other RNA
gcacggtgaacttcttgggttgcttcctctt

SEQ ID NO: 600 - RNA, 31 nt, synthetic construct
  misc_feature 1..31: note = Synthetic Oligonucleotide
  source 1..31: mol_type = other RNA
gagtagagatgcagctggagccatcaaacac

SEQ ID NO: 601 - RNA, 31 nt, synthetic construct
  misc_feature 1..31: note = Synthetic Oligonucleotide
  source 1..31: mol_type = other RNA
ggtagtagagatgcagctggagccatcaaac

SEQ ID NO: 602 - RNA, 31 nt, synthetic construct; identical to SEQ ID NO: 398
  misc_feature 1..31: note = Synthetic Oligonucleotide
  source 1..31: mol_type = other RNA

SEQ ID NO: 603 - RNA, 31 nt, synthetic construct
  misc_feature 1..31: note = Synthetic Oligonucleotide
  source 1..31: mol_type = other RNA
gtattgtagtagagatgcagctggagccatc

SEQ ID NO: 604 - RNA, 31 nt, synthetic construct
  misc_feature 1..31: note = Synthetic Oligonucleotide
  source 1..31: mol_type = other RNA
gactattgtagtagagatgcagctggagcca

SEQ ID NO: 605 - RNA, 31 nt, synthetic construct
  misc_feature 1..31: note = Synthetic Oligonucleotide
  source 1..31: mol_type = other RNA
gtatcatcttctgcagccactgggatgattt

SEQ ID NO: 606 - RNA, 31 nt, synthetic construct
  source 1..31: mol_type = other RNA; note = Synthetic Oligonucleotide
gtctccaccccaaaagctgtgatcttctcct

SEQ ID NO: 607 - RNA, 31 nt, synthetic construct
  misc_feature 1..31: note = Synthetic Oligonucleotide
  source 1..31: mol_type = other RNA
ggaactcacccttggccaagagctcacactt

SEQ ID NO: 608 - RNA, 31 nt, synthetic construct
  misc_feature 1..31: note = Synthetic Oligonucleotide
  source 1..31: mol_type = other RNA
ggagccctcatcaaggtctgtacaagtgaag

SEQ ID NO: 609 - RNA, 31 nt, synthetic construct
  misc_feature 1..31: note = Synthetic Oligonucleotide
  source 1..31: mol_type = other RNA
gctgtggcggcatttgccggcagtccggctt

SEQ ID NO: 610 - RNA, 31 nt, synthetic construct
  misc_feature 1..31: note = Synthetic Oligonucleotide
  source 1..31: mol_type = other RNA
ggcctggcgggtccccccaaccaccccaggc

SEQ ID NO: 611 - RNA, 31 nt, synthetic construct
  misc_feature 1..31: note = Synthetic Oligonucleotide
  source 1..31: mol_type = other RNA
gagaagcctgttcatcacgttgacatactga

SEQ ID NO: 612 - RNA, 31 nt, synthetic construct
  misc_feature 1..31: note = Synthetic Oligonucleotide
  source 1..31: mol_type = other RNA
gctccaaacctaactctgctgcttccactgc

SEQ ID NO: 613 - RNA, 31 nt, synthetic construct
  misc_feature 1..31: note = Synthetic Oligonucleotide
  source 1..31: mol_type = other RNA
gtggcatctcttgaggtcaggaggggggcca

SEQ ID NO: 614 - RNA, 31 nt, synthetic construct
  misc_feature 1..31: note = Synthetic Oligonucleotide
  source 1..31: mol_type = other RNA
gtctttccgagtatacactggcagtgtgata

SEQ ID NO: 615 - RNA, 31 nt, synthetic construct
  misc_feature 1..31: note = Synthetic Oligonucleotide
  source 1..31: mol_type = other RNA
gctttccacctgggccaggggaatcaagcac

SEQ ID NO: 616 - RNA, 31 nt, synthetic construct
  misc_feature 1..31: note = Synthetic Oligonucleotide
  source 1..31: mol_type = other RNA
gttctccccctagtccccgtttttcttctct

SEQ ID NO: 617 - RNA, 31 nt, synthetic construct
  misc_feature 1..31: note = Synthetic Oligonucleotide
  source 1..31: mol_type = other RNA
gtggactgccgctcctgcacctgcgcctcca

SEQ ID NO: 618 - RNA, 31 nt, synthetic construct
  misc_feature 1..31: note = Synthetic Oligonucleotide
  source 1..31: mol_type = other RNA
gatgatcaacgggcaggatgtttttatatct

SEQ ID NO: 619 - RNA, 31 nt, synthetic construct
  misc_feature 1..31: note = Synthetic Oligonucleotide
  source 1..31: mol_type = other RNA
ggcccctagccggatgtgggagatggggaag

SEQ ID NO: 620 - RNA, 31 nt, synthetic construct
  misc_feature 1..31: note = Synthetic Oligonucleotide
  source 1..31: mol_type = other RNA
gtgtgtaaccggcagaggctgtagtttcaat

SEQ ID NO: 621 - RNA, 31 nt, synthetic construct
  misc_feature 1..31: note = Synthetic Oligonucleotide
  source 1..31: mol_type = other RNA
gccgcgtcccctctcttgggttcttgtacaa

SEQ ID NO: 622 - RNA, 31 nt, synthetic construct
  misc_feature 1..31: note = Synthetic Oligonucleotide
  source 1..31: mol_type = other RNA
gcatctgtcctttctactgtatcttctatat

SEQ ID NO: 623 - RNA, 31 nt, synthetic construct
  misc_feature 1..31: note = Synthetic Oligonucleotide
  source 1..31: mol_type = other RNA
gcaacagcccgggttaagttaatcaggtaga

SEQ ID NO: 624 - RNA, 31 nt, synthetic construct; identical to SEQ ID NO: 623
  misc_feature 1..31: note = Synthetic Oligonucleotide
  source 1..31: mol_type = other RNA

SEQ ID NO: 625 - RNA, 31 nt, synthetic construct
  misc_feature 1..31: note = Synthetic Oligonucleotide
  source 1..31: mol_type = other RNA
ggtcccactgccgctgtcgctggggatcgtc

SEQ ID NO: 626 - RNA, 31 nt, synthetic construct
  misc_feature 1..31: note = Synthetic Oligonucleotide
  source 1..31: mol_type = other RNA
gtcgccgaagcacttctcctcctcagggaag

SEQ ID NO: 627 - RNA, 31 nt, synthetic construct
  misc_feature 1..31: note = Synthetic Oligonucleotide
  source 1..31: mol_type = other RNA
gtcatcttctgcagccactgggatgatttcc

SEQ ID NO: 628 - RNA, 31 nt, synthetic construct; identical to SEQ ID NO: 605
  misc_feature 1..31: note = Synthetic Oligonucleotide
  source 1..31: mol_type = other RNA

SEQ ID NO: 629 - RNA, 31 nt, synthetic construct
  misc_feature 1..31: note = Synthetic Oligonucleotide
  source 1..31: mol_type = other RNA
gtttatcatcttctgcagccactgggatgat

SEQ ID NO: 630 - RNA, 31 nt, synthetic construct
  misc_feature 1..31: note = Synthetic Oligonucleotide
  source 1..31: mol_type = other RNA
gcaccccaaaagctgtgatcttctccttcac

SEQ ID NO: 631 - RNA, 31 nt, synthetic construct
  misc_feature 1..31: note = Synthetic Oligonucleotide
  source 1..31: mol_type = other RNA
gtccaccccaaaagctgtgatcttctccttc

SEQ ID NO: 632 - RNA, 31 nt, synthetic construct; identical to SEQ ID NO: 606
  misc_feature 1..31: note = Synthetic Oligonucleotide
  source 1..31: mol_type = other RNA

SEQ ID NO: 633 - RNA, 31 nt, synthetic construct
  misc_feature 1..31: note = Synthetic Oligonucleotide
  source 1..31: mol_type = other RNA
gtcacccttggccaagagctcacacttcagg

SEQ ID NO: 634 - RNA, 31 nt, synthetic construct
  misc_feature 1..31: note = Synthetic Oligonucleotide
  source 1..31: mol_type = other RNA
gactcacccttggccaagagctcacacttca

SEQ ID NO: 635 - RNA, 31 nt, synthetic construct; identical to SEQ ID NO: 607
  misc_feature 1..31: note = Synthetic Oligonucleotide
  source 1..31: mol_type = other RNA

SEQ ID NO: 636 - RNA, 31 nt, synthetic construct; identical to SEQ ID NO: 608
  misc_feature 1..31: note = Synthetic Oligonucleotide
  source 1..31: mol_type = other RNA

SEQ ID NO: 637 - RNA, 31 nt, synthetic construct
  misc_feature 1..31: note = Synthetic Oligonucleotide
  source 1..31: mol_type = other RNA
gcagagccctcatcaaggtctgtacaagtga

SEQ ID NO: 638 - RNA, 31 nt, synthetic construct
  misc_feature 1..31: note = Synthetic Oligonucleotide
  source 1..31: mol_type = other RNA
gctcagagccctcatcaaggtctgtacaagt

SEQ ID NO: 639 - RNA, 31 nt, synthetic construct
  misc_feature 1..31: note = Synthetic Oligonucleotide
  source 1..31: mol_type = other RNA
ggtggcggcatttgccggcagtccggcttgg

SEQ ID NO: 640 - RNA, 31 nt, synthetic construct; identical to SEQ ID NO: 609
  misc_feature 1..31: note = Synthetic Oligonucleotide
  source 1..31: mol_type = other RNA

SEQ ID NO: 641 - RNA, 31 nt, synthetic construct
  misc_feature 1..31: note = Synthetic Oligonucleotide
  source 1..31: mol_type = other RNA
gcactgtggcggcatttgccggcagtccggc

SEQ ID NO: 642 - RNA, 31 nt, synthetic construct
  misc_feature 1..31: note = Synthetic Oligonucleotide
  source 1..31: mol_type = other RNA
gctggcgggtccccccaaccaccccaggcac

SEQ ID NO: 643 - RNA, 31 nt, synthetic construct; identical to SEQ ID NO: 610
  misc_feature 1..31: note = Synthetic Oligonucleotide
  source 1..31: mol_type = other RNA

SEQ ID NO: 644 - RNA, 31 nt, synthetic construct
  misc_feature 1..31: note = Synthetic Oligonucleotide
  source 1..31: mol_type = other RNA
gccgcctggcgggtccccccaaccaccccag

SEQ ID NO: 645 - RNA, 31 nt, synthetic construct
  misc_feature 1..31: note = Synthetic Oligonucleotide
  source 1..31: mol_type = other RNA
gaagcctgttcatcacgttgacatactgatt

SEQ ID NO: 646 - RNA, 31 nt, synthetic construct; identical to SEQ ID NO: 611
  misc_feature 1..31: note = Synthetic Oligonucleotide
  source 1..31: mol_type = other RNA

SEQ ID NO: 647 - RNA, 31 nt, synthetic construct
  misc_feature 1..31: note = Synthetic Oligonucleotide
  source 1..31: mol_type = other RNA
gaaagaagcctgttcatcacgttgacatact

SEQ ID NO: 648 - RNA, 31 nt, synthetic construct
  misc_feature 1..31: note = Synthetic Oligonucleotide
  source 1..31: mol_type = other RNA
gaaacctaactctgctgcttccactgctctg

SEQ ID NO: 649 - RNA, 31 nt, synthetic construct
  misc_feature 1..31: note = Synthetic Oligonucleotide
  source 1..31: mol_type = other RNA
gccaaacctaactctgctgcttccactgctc

SEQ ID NO: 650 - RNA, 31 nt, synthetic construct; identical to SEQ ID NO: 612
  misc_feature 1..31: note = Synthetic Oligonucleotide
  source 1..31: mol_type = other RNA

SEQ ID NO: 651 - RNA, 31 nt, synthetic construct
  misc_feature 1..31: note = Synthetic Oligonucleotide
  source 1..31: mol_type = other RNA
gatctcttgaggtcaggaggggggccacgat

SEQ ID NO: 652 - RNA, 31 nt, synthetic construct
  misc_feature 1..31: note = Synthetic Oligonucleotide
  source 1..31: mol_type = other RNA
ggcatctcttgaggtcaggaggggggccacg

SEQ ID NO: 653 - RNA, 31 nt, synthetic construct; identical to SEQ ID NO: 613
  misc_feature 1..31: note = Synthetic Oligonucleotide
  source 1..31: mol_type = other RNA

SEQ ID NO: 654 - RNA, 31 nt, synthetic construct
  misc_feature 1..31: note = Synthetic Oligonucleotide
  source 1..31: mol_type = other RNA
gtttccgagtatacactggcagtgtgatatt

SEQ ID NO: 655 - RNA, 31 nt, synthetic construct; identical to SEQ ID NO: 614
  misc_feature 1..31: note = Synthetic Oligonucleotide
  source 1..31: mol_type = other RNA

SEQ ID NO: 656 - RNA, 31 nt, synthetic construct
  misc_feature 1..31: note = Synthetic Oligonucleotide
  source 1..31: mol_type = other RNA
ggctctttccgagtatacactggcagtgtga

SEQ ID NO: 657 - RNA, 31 nt, synthetic construct
  misc_feature 1..31: note = Synthetic Oligonucleotide
  source 1..31: mol_type = other RNA
gccacctgggccaggggaatcaagcactttg

SEQ ID NO: 658 - RNA, 31 nt, synthetic construct
  misc_feature 1..31: note = Synthetic Oligonucleotide
  source 1..31: mol_type = other RNA
gttccacctgggccaggggaatcaagcactt

SEQ ID NO: 659 - RNA, 31 nt, synthetic construct; identical to SEQ ID NO: 615
  misc_feature 1..31: note = Synthetic Oligonucleotide
  source 1..31: mol_type = other RNA

SEQ ID NO: 660 - RNA, 31 nt, synthetic construct
  misc_feature 1..31: note = Synthetic Oligonucleotide
  source 1..31: mol_type = other RNA
gccccctagtccccgtttttcttctctctct

SEQ ID NO: 661 - RNA, 31 nt, synthetic construct
  misc_feature 1..31: note = Synthetic Oligonucleotide
  source 1..31: mol_type = other RNA
gctccccctagtccccgtttttcttctctct

SEQ ID NO: 662 - RNA, 31 nt, synthetic construct; identical to SEQ ID NO: 616
  misc_feature 1..31: note = Synthetic Oligonucleotide
  source 1..31: mol_type = other RNA

SEQ ID NO: 663 - RNA, 31 nt, synthetic construct
  misc_feature 1..31: note = Synthetic Oligonucleotide
  source 1..31: mol_type = other RNA
gctgccgctcctgcacctgcgcctccagctt

SEQ ID NO: 664 - RNA, 31 nt, synthetic construct
  misc_feature 1..31: note = Synthetic Oligonucleotide
  source 1..31: mol_type = other RNA
ggactgccgctcctgcacctgcgcctccagc

SEQ ID NO: 665 - RNA, 31 nt, synthetic construct; identical to SEQ ID NO: 617
  misc_feature 1..31: note = Synthetic Oligonucleotide
  source 1..31: mol_type = other RNA

SEQ ID NO: 666 - RNA, 31 nt, synthetic construct
  misc_feature 1..31: note = Synthetic Oligonucleotide
  source 1..31: mol_type = other RNA
gtcaacgggcaggatgtttttatatctattt

SEQ ID NO: 667 - RNA, 31 nt, synthetic construct
  misc_feature 1..31: note = Synthetic Oligonucleotide
  source 1..31: mol_type = other RNA
ggatcaacgggcaggatgtttttatatctat

SEQ ID NO: 668 - RNA, 31 nt, synthetic construct; identical to SEQ ID NO: 618
  misc_feature 1..31: note = Synthetic Oligonucleotide
  source 1..31: mol_type = other RNA

SEQ ID NO: 669 - RNA, 31 nt, synthetic construct; identical to SEQ ID NO: 619
  misc_feature 1..31: note = Synthetic Oligonucleotide
  source 1..31: mol_type = other RNA

SEQ ID NO: 670 - RNA, 31 nt, synthetic construct
  misc_feature 1..31: note = Synthetic Oligonucleotide
  source 1..31: mol_type = other RNA
ggggcccctagccggatgtgggagatgggga

SEQ ID NO: 671 - RNA, 31 nt, synthetic construct
  misc_feature 1..31: note = Synthetic Oligonucleotide
  source 1..31: mol_type = other RNA
gcagggcccctagccggatgtgggagatggg

SEQ ID NO: 672 - RNA, 31 nt, synthetic construct
  misc_feature 1..31: note = Synthetic Oligonucleotide
  source 1..31: mol_type = other RNA
gtaaccggcagaggctgtagtttcaatgaga

SEQ ID NO: 673 - RNA, 31 nt, synthetic construct
  misc_feature 1..31: note = Synthetic Oligonucleotide
  source 1..31: mol_type = other RNA
gtgtaaccggcagaggctgtagtttcaatga

SEQ ID NO: 674 - RNA, 31 nt, synthetic construct; identical to SEQ ID NO: 620
  misc_feature 1..31: note = Synthetic Oligonucleotide
  source 1..31: mol_type = other RNA

SEQ ID NO: 675 - RNA, 31 nt, synthetic construct
  misc_feature 1..31: note = Synthetic Oligonucleotide
  source 1..31: mol_type = other RNA
ggtcccctctcttgggttcttgtacaaggcg

SEQ ID NO: 676 - RNA, 31 nt, synthetic construct
  misc_feature 1..31: note = Synthetic Oligonucleotide
  source 1..31: mol_type = other RNA
ggcgtcccctctcttgggttcttgtacaagg

SEQ ID NO: 677 - RNA, 31 nt, synthetic construct; identical to SEQ ID NO: 621
  misc_feature 1..31: note = Synthetic Oligonucleotide
  source 1..31: mol_type = other RNA

SEQ ID NO: 678 - RNA, 31 nt, synthetic construct
  misc_feature 1..31: note = Synthetic Oligonucleotide
  source 1..31: mol_type = other RNA
gtgtcctttctactgtatcttctatatggcc

SEQ ID NO: 679 - RNA, 31 nt, synthetic construct
  misc_feature 1..31: note = Synthetic Oligonucleotide
  source 1..31: mol_type = other RNA
gtctgtcctttctactgtatcttctatatgg

SEQ ID NO: 680 - RNA, 31 nt, synthetic construct; identical to SEQ ID NO: 622
  misc_feature 1..31: note = Synthetic Oligonucleotide
  source 1..31: mol_type = other RNA

SEQ ID NO: 681 - RNA, 31 nt, synthetic construct
  misc_feature 1..31: note = Synthetic Oligonucleotide
  source 1..31: mol_type = other RNA
gagcccgggttaagttaatcaggtagaagga

SEQ ID NO: 682 - RNA, 31 nt, synthetic construct
  misc_feature 1..31: note = Synthetic Oligonucleotide
  source 1..31: mol_type = other RNA
gacagcccgggttaagttaatcaggtagaag

SEQ ID NO: 683 - RNA, 31 nt, synthetic construct; identical to SEQ ID NO: 623
  misc_feature 1..31: note = Synthetic Oligonucleotide
  source 1..31: mol_type = other RNA

SEQ ID NO: 684 - RNA, 31 nt, synthetic construct
  misc_feature 1..31: note = Synthetic Oligonucleotide
  source 1..31: mol_type = other RNA
ggtcccgaacctgttcttctgtggtaacggg

SEQ ID NO: 685 - RNA, 31 nt, synthetic construct
  misc_feature 1..31: note = Synthetic Oligonucleotide
  source 1..31: mol_type = other RNA
gacgtcccgaacctgttcttctgtggtaacg

SEQ ID NO: 686 - RNA, 31 nt, synthetic construct
  misc_feature 1..31: note = Synthetic Oligonucleotide
  source 1..31: mol_type = other RNA
gtgacgtcccgaacctgttcttctgtggtaa

SEQ ID NO: 687 - RNA, 31 nt, synthetic construct
  misc_feature 1..31: note = Synthetic Oligonucleotide
  source 1..31: mol_type = other RNA
gcccactgccgctgtcgctggggatcgtctc

SEQ ID NO: 688 - RNA, 31 nt, synthetic construct; identical to SEQ ID NO: 625
  misc_feature 1..31: note = Synthetic Oligonucleotide
  source 1..31: mol_type = other RNA

SEQ ID NO: 689 - RNA, 31 nt, synthetic construct
  misc_feature 1..31: note = Synthetic Oligonucleotide
  source 1..31: mol_type = other RNA
gctgtcccactgccgctgtcgctggggatcg

SEQ ID NO: 690 - RNA, 31 nt, synthetic construct; identical to SEQ ID NO: 626
  misc_feature 1..31: note = Synthetic Oligonucleotide
  source 1..31: mol_type = other RNA

SEQ ID NO: 691 - RNA, 31 nt, synthetic construct
  misc_feature 1..31: note = Synthetic Oligonucleotide
  source 1..31: mol_type = other RNA
ggctcgccgaagcacttctcctcctcaggga

SEQ ID NO: 692 - RNA, 31 nt, synthetic construct
  misc_feature 1..31: note = Synthetic Oligonucleotide
  source 1..31: mol_type = other RNA
ggggctcgccgaagcacttctcctcctcagg

SEQ ID NO: 693 - RNA, 31 nt, synthetic construct
  misc_feature 1..31: note = Synthetic Oligonucleotide
  source 1..31: mol_type = other RNA
gccacgtcctccatgtccgcgcccagccggg

SEQ ID NO: 694 - RNA, 31 nt, synthetic construct
  misc_feature 1..31: note = Synthetic Oligonucleotide
  source 1..31: mol_type = other RNA
ggcccacgtcctccatgtccgcgcccagccg

SEQ ID NO: 695 - RNA, 31 nt, synthetic construct
  misc_feature 1..31: note = Synthetic Oligonucleotide
  source 1..31: mol_type = other RNA
gccgcccacgtcctccatgtccgcgcccagc

SEQ ID NO: 696 - RNA, 31 nt, synthetic construct
  misc_feature 1..31: note = Synthetic Oligonucleotide
  source 1..31: mol_type = other RNA
gggccgcccacgtcctccatgtccgcgccca

SEQ ID NO: 697 - RNA, 31 nt, synthetic construct
  misc_feature 1..31: note = Synthetic Oligonucleotide
  source 1..31: mol_type = other RNA
ggcggccgcccacgtcctccatgtccgcgcc

SEQ ID NO: 698 - RNA, 31 nt, synthetic construct
  misc_feature 1..31: note = Synthetic Oligonucleotide
  source 1..31: mol_type = other RNA
gaggcggccgcccacgtcctccatgtccgcg

SEQ ID NO: 699 - RNA, 31 nt, synthetic construct
  misc_feature 1..31: note = Synthetic Oligonucleotide
  source 1..31: mol_type = other RNA
gccaggcggccgcccacgtcctccatgtccg

SEQ ID NO: 700 - RNA, 31 nt, synthetic construct
  misc_feature 1..31: note = Synthetic Oligonucleotide
  source 1..31: mol_type = other RNA
gcaccaggcggccgcccacgtcctccatgtc

SEQ ID NO: 701 - RNA, 31 nt, synthetic construct
  misc_feature 1..31: note = Synthetic Oligonucleotide
  source 1..31: mol_type = other RNA
gccttctgcaggtcatcggcatcgcggagga

SEQ ID NO: 702 - RNA, 31 nt, synthetic construct
  misc_feature 1..31: note = Synthetic Oligonucleotide
  source 1..31: mol_type = other RNA
ggcccttctgcaggtcatcggcatcgcggag

SEQ ID NO: 703 - RNA, 31 nt, synthetic construct
  misc_feature 1..31: note = Synthetic Oligonucleotide
  source 1..31: mol_type = other RNA
gaggcccttctgcaggtcatcggcatcgcgg

SEQ ID NO: 704 - RNA, 31 nt, synthetic construct
  misc_feature 1..31: note = Synthetic Oligonucleotide
  source 1..31: mol_type = other RNA
gccaggcccttctgcaggtcatcggcatcgc

SEQ ID NO: 705 - RNA, 31 nt, synthetic construct
  misc_feature 1..31: note = Synthetic Oligonucleotide
  source 1..31: mol_type = other RNA
gtgccaggcccttctgcaggtcatcggcatc

SEQ ID NO: 706 - RNA, 31 nt, synthetic construct
  misc_feature 1..31: note = Synthetic Oligonucleotide
  source 1..31: mol_type = other RNA
gactgccaggcccttctgcaggtcatcggca

SEQ ID NO: 707 - RNA, 31 nt, synthetic construct
  misc_feature 1..31: note = Synthetic Oligonucleotide
  source 1..31: mol_type = other RNA
gacactgccaggcccttctgcaggtcatcgg

SEQ ID NO: 708 - RNA, 31 nt, synthetic construct
  misc_feature 1..31: note = Synthetic Oligonucleotide
  source 1..31: mol_type = other RNA
ggtacactgccaggcccttctgcaggtcatc

SEQ ID NO: 709 - RNA, 50 nt, synthetic construct
  misc_feature 1..50: note = Synthetic Oligonucleotide
  source 1..50: mol_type = other RNA
tcttatggcaaccgcatgagccttgaacgcactctcactacggtgatgat

SEQ ID NO: 710 - RNA, 31 nt, synthetic construct
  misc_feature 1..31: note = Synthetic Oligonucleotide
  source 1..31: mol_type = other RNA
gcttgcaagtgcctcatccaaaggcgcaaat

SEQ ID NO: 711 - RNA, 50 nt, synthetic construct
  misc_feature 1..50: note = Synthetic Oligonucleotide
  source 1..50: mol_type = other RNA
aaacattgaacaccattagttaaagtagtgactaaggttggccatggaac

SEQ ID NO: 712 - protein, 22 aa, unidentified
TRGCLICLSHINRTPKMKKFIP

SEQ ID NO: 713 - RNA, 66 nt, unidentified
  source 1..66: mol_type = other RNA
accaggggctgtctgatctgcctgtcccacatcaatcgcacgcccaagatgaagaagttcatccca

SEQ ID NO: 714 - RNA, 29 nt, unidentified
  source 1..29: mol_type = other RNA
tgccattgatgtgggacaggcagatcaga

SEQ ID NO: 715 - protein, 17 aa, synthetic construct
  REGION 1..17: note = Synthetic Peptide
DSGIHSGATTTAPSLSG

SEQ ID NO: 716 - RNA, 57 nt, synthetic construct
  misc_feature 1..57: note = Synthetic Oligonucleotide
  source 1..57: mol_type = other RNA
tacctggactctggaatccattctggtgccactagcacagctccttctctgagtggt

SEQ ID NO: 717 - RNA, 31 nt, synthetic construct; identical to SEQ ID NO: 378
  misc_feature 1..31: note = Synthetic Oligonucleotide
  source 1..31: mol_type = other RNA

SEQ ID NO: 718 - RNA, 36 nt, unidentified; identical to SEQ ID NO: 65
  source 1..36: mol_type = other RNA

SEQ ID NO: 719 - RNA, 66 nt, unidentified; identical to SEQ ID NO: 66
  source 1..66: mol_type = other RNA

SEQ ID NO: 720 - RNA, 14 nt, synthetic construct
  misc_feature 1..14: note = Synthetic Oligonucleotide
  source 1..14: mol_type = other RNA
tccccacattcgac

SEQ ID NO: 721 - RNA, 14 nt, synthetic construct
  misc_feature 1..14: note = Synthetic Oligonucleotide
  source 1..14: mol_type = other RNA
ggccaatgtgggga

SEQ ID NO: 722 - DNA, 36 bp, unidentified
  source 1..36: mol_type = other DNA
tgcctgtcccacatcaatcgcacgcccaagatgaag

SEQ ID NO: 723 - DNA, 35 bp, unidentified
  source 1..35: mol_type = other DNA
tgcctgtcccacatcaattgcacgcccaagatgag

SEQ ID NO: 724 - DNA, 35 bp, unidentified
  source 1..35: mol_type = other DNA
tgcctgtcccacatcaattgcacgcccaagatgaa

SEQ ID NO: 725 - DNA, 35 bp, unidentified
  source 1..35: mol_type = other DNA
tgcctgtcccacatcagttgcacgcccaagatgaa

SEQ ID NO: 726 - DNA, 35 bp, unidentified; identical to SEQ ID NO: 724
  source 1..35: mol_type = other DNA

SEQ ID NO: 727 - DNA, 35 bp, unidentified
  source 1..35: mol_type = other DNA
tgcctgtcccgcatcaattgcacgcccaagatgaa

SEQ ID NO: 728 - DNA, 35 bp, unidentified; identical to SEQ ID NO: 724
  source 1..35: mol_type = other DNA

SEQ ID NO: 729 - DNA, 35 bp, unidentified
  source 1..35: mol_type = other DNA
tgcctgtcccacatcaatcgcacgcccaagatgaa

SEQ ID NO: 730 - DNA, 35 bp, unidentified; identical to SEQ ID NO: 727
  source 1..35: mol_type = other DNA

SEQ ID NO: 731 - DNA, 35 bp, unidentified; identical to SEQ ID NO: 724
  source 1..35: mol_type = other DNA

SEQ ID NO: 732 - DNA, 35 bp, unidentified; identical to SEQ ID NO: 727
  source 1..35: mol_type = other DNA

SEQ ID NO: 733 - DNA, 35 bp, unidentified; identical to SEQ ID NO: 729
  source 1..35: mol_type = other DNA

SEQ ID NO: 734 - DNA, 35 bp, unidentified; identical to SEQ ID NO: 729
  source 1..35: mol_type = other DNA

SEQ ID NO: 735 - DNA, 35 bp, unidentified; identical to SEQ ID NO: 724
  source 1..35: mol_type = other DNA

SEQ ID NO: 736 - DNA, 35 bp, unidentified; identical to SEQ ID NO: 727
  source 1..35: mol_type = other DNA

SEQ ID NO: 737 - DNA, 35 bp, unidentified; identical to SEQ ID NO: 725
  source 1..35: mol_type = other DNA

SEQ ID NO: 738 - DNA, 35 bp, unidentified; identical to SEQ ID NO: 724
  source 1..35: mol_type = other DNA

SEQ ID NO: 739 - DNA, 35 bp, unidentified
  source 1..35: mol_type = other DNA
gcctgtcccacatcaattgcacgcccaggatgaag

SEQ ID NO: 740 - DNA, 35 bp, unidentified
  source 1..35: mol_type = other DNA
gcctgtcccacatcagttgcacgcccaagatgaag

SEQ ID NO: 741 - DNA, 35 bp, unidentified
  source 1..35: mol_type = other DNA
gcctgtcccgcatcaattgcacgcccaagatgaag

SEQ ID NO: 742 - DNA, 35 bp, unidentified
  source 1..35: mol_type = other DNA
gcctgtcccacatcaattgcacgcccaagatgaag

SEQ ID NO: 743 - DNA, 35 bp, unidentified
  source 1..35: mol_type = other DNA
gcctgtcccacatcaatcgcacgcccaagatgaag

SEQ ID NO: 744 - DNA, 35 bp, unidentified; identical to SEQ ID NO: 740
  source 1..35: mol_type = other DNA

SEQ ID NO: 745 - DNA, 36 bp, unidentified; identical to SEQ ID NO: 722
  source 1..36: mol_type = other DNA

SEQ ID NO: 746 - DNA, 35 bp, unidentified; identical to SEQ ID NO: 724
  source 1..35: mol_type = other DNA

SEQ ID NO: 747 - DNA, 35 bp, unidentified; identical to SEQ ID NO: 724
  source 1..35: mol_type = other DNA

SEQ ID NO: 748 - DNA, 35 bp, unidentified; identical to SEQ ID NO: 724
  source 1..35: mol_type = other DNA

SEQ ID NO: 749 - DNA, 35 bp, unidentified; identical to SEQ ID NO: 724
  source 1..35: mol_type = other DNA

SEQ ID NO: 750 - DNA, 35 bp, unidentified; identical to SEQ ID NO: 724
  source 1..35: mol_type = other DNA

SEQ ID NO: 751 - DNA, 35 bp, unidentified; identical to SEQ ID NO: 724
  source 1..35: mol_type = other DNA

SEQ ID NO: 752 - DNA, 35 bp, unidentified; identical to SEQ ID NO: 729
  source 1..35: mol_type = other DNA

SEQ ID NO: 753 - DNA, 35 bp, unidentified; identical to SEQ ID NO: 724
  source 1..35: mol_type = other DNA

SEQ ID NO: 754 - DNA, 35 bp, unidentified; identical to SEQ ID NO: 729
  source 1..35: mol_type = other DNA

SEQ ID NO: 755 - DNA, 35 bp, unidentified; identical to SEQ ID NO: 724
  source 1..35: mol_type = other DNA

SEQ ID NO: 756 - DNA, 35 bp, unidentified; identical to SEQ ID NO: 729
  source 1..35: mol_type = other DNA

SEQ ID NO: 757 - DNA, 35 bp, unidentified; identical to SEQ ID NO: 729
  source 1..35: mol_type = other DNA

SEQ ID NO: 758 - DNA, 35 bp, unidentified; identical to SEQ ID NO: 724
  source 1..35: mol_type = other DNA

SEQ ID NO: 759 - DNA, 35 bp, unidentified; identical to SEQ ID NO: 724
  source 1..35: mol_type = other DNA

SEQ ID NO: 760 - DNA, 35 bp, unidentified; identical to SEQ ID NO: 724
  source 1..35: mol_type = other DNA

SEQ ID NO: 761 - DNA, 35 bp, unidentified; identical to SEQ ID NO: 729
  source 1..35: mol_type = other DNA

SEQ ID NO: 762 - DNA, 35 bp, unidentified
  source 1..35: mol_type = other DNA
gcctgtcccacatcaattgcacgcccaagattaag

SEQ ID NO: 763 - DNA, 35 bp, unidentified; identical to SEQ ID NO: 743
  source 1..35: mol_type = other DNA

SEQ ID NO: 764 - DNA, 35 bp, unidentified; identical to SEQ ID NO: 742
  source 1..35: mol_type = other DNA

SEQ ID NO: 765 - DNA, 35 bp, unidentified; identical to SEQ ID NO: 743
  source 1..35: mol_type = other DNA

SEQ ID NO: 766 - DNA, 35 bp, unidentified; identical to SEQ ID NO: 742
  source 1..35: mol_type = other DNA

SEQ ID NO: 767 - DNA, 35 bp, unidentified; identical to SEQ ID NO: 743
  source 1..35: mol_type = other DNA

SEQ ID NO: 768 - protein, 17 aa, synthetic construct
  REGION 1..17: note = Synthetic Peptide
TCSNTIDLPMSPRTLDS

SEQ ID NO: 769 - RNA, 58 nt, synthetic construct
  misc_feature 1..58: note = Synthetic Oligonucleotide
  source 1..58: mol_type = other RNA
caacgacctgcagcaataccattgacctgccgatgtcccccccgcactttagattcat

SEQ ID NO: 770 - RNA, 31 nt, synthetic construct; identical to SEQ ID NO: 400
  misc_feature 1..31: note = Synthetic Oligonucleotide
  source 1..31: mol_type = other RNA

SEQ ID NO: 771 - RNA, 78 nt, unidentified
  source 1..78: mol_type = other RNA
tgtctgatctgcctgtcccacatcaatcgcacgcccaagatgaagaagttcatcccaggacgctgccacacctacgaa

SEQ ID NO: 772 - RNA, 48 nt, synthetic construct
  misc_feature 1..48: note = Synthetic Oligonucleotide
  source 1..48: mol_type = other RNA
aagagtgccttgacgatacagctaattcagaatcattttgtggacgaa

SEQ ID NO: 773 - RNA, 60 nt, synthetic construct
  misc_feature 1..60: note = Synthetic Oligonucleotide
  source 1..60: mol_type = other RNA
agtcactggcagcaacagtcttacctggactctggaatccattctggtgccactaccaca

SEQ ID NO: 774 - RNA, 30 nt, synthetic construct
  misc_feature 1..30: note = Synthetic Oligonucleotide
  source 1..30: mol_type = other RNA
cattctggtgccactaccacagctccttct

SEQ ID NO: 775 - protein, 17 aa, synthetic construct
  REGION 1..17: note = Synthetic Peptide
PEADPGSAAPYLKTKFI

SEQ ID NO: 776 - DNA, 57 bp, synthetic construct; identical to SEQ ID NO: 70
  misc_feature 1..57: note = Synthetic Oligonucleotide
  source 1..57: mol_type = other DNA

SEQ ID NO: 777 - protein, 17 aa, synthetic construct
  REGION 1..17: note = Synthetic Peptide
TCSNTIDLPMSPRTLDS

SEQ ID NO: 778 - DNA, 57 bp, synthetic construct; identical to SEQ ID NO: 73
  misc_feature 1..57: note = Synthetic Oligonucleotide
  source 1..57: mol_type = other DNA

SEQ ID NO: 779 - protein, 15 aa, synthetic construct
  REGION 1..15: note = Synthetic Peptide
GSSLQKKLEELELGS

SEQ ID NO: 780 - RNA, 30 nt, synthetic construct; identical to SEQ ID NO: 310
  misc_feature 1..30: note = Synthetic Oligonucleotide
  source 1..30: mol_type = other RNA

SEQ ID NO: 781 - RNA, 31 nt, synthetic construct; identical to SEQ ID NO: 311
  misc_feature 1..31: note = Synthetic Oligonucleotide
  source 1..31: mol_type = other RNA

SEQ ID NO: 782 - RNA, 31 nt, synthetic construct; identical to SEQ ID NO: 312
  misc_feature 1..31: note = Synthetic Oligonucleotide
  source 1..31: mol_type = other RNA

SEQ ID NO: 783 - RNA, 30 nt, synthetic construct; identical to SEQ ID NO: 313
  misc_feature 1..30: note = Synthetic Oligonucleotide
  source 1..30: mol_type = other RNA

SEQ ID NO: 784 - RNA, 31 nt, synthetic construct; identical to SEQ ID NO: 314
  misc_feature 1..31: note = Synthetic Oligonucleotide
  source 1..31: mol_type = other RNA

SEQ ID NO: 785 - RNA, 31 nt, synthetic construct; identical to SEQ ID NO: 315
  misc_feature 1..31: note = Synthetic Oligonucleotide
  source 1..31: mol_type = other RNA

SEQ ID NO: 786 - RNA, 30 nt, synthetic construct; identical to SEQ ID NO: 316
  misc_feature 1..30: note = Synthetic Oligonucleotide
  source 1..30: mol_type = other RNA

SEQ ID NO: 787 - RNA, 30 nt, synthetic construct; identical to SEQ ID NO: 317
  misc_feature 1..30: note = Synthetic Oligonucleotide
  source 1..30: mol_type = other RNA

SEQ ID NO: 788 - RNA, 30 nt, synthetic construct; identical to SEQ ID NO: 318
  misc_feature 1..30: note = Synthetic Oligonucleotide
  source 1..30: mol_type = other RNA

SEQ ID NO: 789 - RNA, 30 nt, synthetic construct; identical to SEQ ID NO: 319
  misc_feature 1..30: note = Synthetic Oligonucleotide
  source 1..30: mol_type = other RNA

SEQ ID NO: 790 - RNA, 30 nt, synthetic construct; identical to SEQ ID NO: 320
  misc_feature 1..30: note = Synthetic Oligonucleotide
  source 1..30: mol_type = other RNA

SEQ ID NO: 791 - RNA, 30 nt, synthetic construct; identical to SEQ ID NO: 321
  misc_feature 1..30: note = Synthetic Oligonucleotide
  source 1..30: mol_type = other RNA

SEQ ID NO: 792 - RNA, 30 nt, synthetic construct; identical to SEQ ID NO: 322
  misc_feature 1..30: note = Synthetic Oligonucleotide
  source 1..30: mol_type = other RNA

SEQ ID NO: 793 - RNA, 30 nt, synthetic construct; identical to SEQ ID NO: 323
  misc_feature 1..30: note = Synthetic Oligonucleotide
  source 1..30: mol_type = other RNA

SEQ ID NO: 794 - RNA, 30 nt, synthetic construct; identical to SEQ ID NO: 324
  misc_feature 1..30: note = Synthetic Oligonucleotide
  source 1..30: mol_type = other RNA

SEQ ID NO: 795 - RNA, 30 nt, synthetic construct; identical to SEQ ID NO: 325
  misc_feature 1..30: note = Synthetic Oligonucleotide
  source 1..30: mol_type = other RNA

SEQ ID NO: 796 - RNA, 30 nt, synthetic construct; identical to SEQ ID NO: 326
  misc_feature 1..30: note = Synthetic Oligonucleotide
  source 1..30: mol_type = other RNA

SEQ ID NO: 797 - RNA, 30 nt, synthetic construct; identical to SEQ ID NO: 327
  misc_feature 1..30: note = Synthetic Oligonucleotide
  source 1..30: mol_type = other RNA

SEQ ID NO: 798 - RNA, 30 nt, synthetic construct; identical to SEQ ID NO: 328
  misc_feature 1..30: note = Synthetic Oligonucleotide
  source 1..30: mol_type = other RNA

SEQ ID NO: 799 - RNA, 30 nt, synthetic construct; identical to SEQ ID NO: 329
  misc_feature 1..30: note = Synthetic Oligonucleotide
  source 1..30: mol_type = other RNA

SEQ ID NO: 800 - RNA, 30 nt, synthetic construct; identical to SEQ ID NO: 330
  misc_feature 1..30: note = Synthetic Oligonucleotide
  source 1..30: mol_type = other RNA

SEQ ID NO: 801 - RNA, 30 nt, synthetic construct; identical to SEQ ID NO: 331
  misc_feature 1..30: note = Synthetic Oligonucleotide
  source 1..30: mol_type = other RNA

SEQ ID NO: 802 - RNA, 30 nt, synthetic construct; identical to SEQ ID NO: 332
  misc_feature 1..30: note = Synthetic Oligonucleotide
  source 1..30: mol_type = other RNA

SEQ ID NO: 803 - RNA, 30 nt, synthetic construct; identical to SEQ ID NO: 333
  misc_feature 1..30: note = Synthetic Oligonucleotide
  source 1..30: mol_type = other RNA

SEQ ID NO: 804 - RNA, 30 nt, synthetic construct; identical to SEQ ID NO: 334
  misc_feature 1..30: note = Synthetic Oligonucleotide
  source 1..30: mol_type = other RNA

SEQ ID NO: 805 - RNA, 30 nt, synthetic construct; identical to SEQ ID NO: 335
  misc_feature 1..30: note = Synthetic Oligonucleotide
  source 1..30: mol_type = other RNA

SEQ ID NO: 806 - RNA, 30 nt, synthetic construct; identical to SEQ ID NO: 336
  misc_feature 1..30: note = Synthetic Oligonucleotide
  source 1..30: mol_type = other RNA

SEQ ID NO: 807 - RNA, 30 nt, synthetic construct; identical to SEQ ID NO: 337
  misc_feature 1..30: note = Synthetic Oligonucleotide
  source 1..30: mol_type = other RNA

SEQ ID NO: 808 - RNA, 30 nt, synthetic construct; identical to SEQ ID NO: 338
  misc_feature 1..30: note = Synthetic Oligonucleotide
  source 1..30: mol_type = other RNA

SEQ ID NO: 809 - RNA, 30 nt, synthetic construct; identical to SEQ ID NO: 339
  misc_feature 1..30: note = Synthetic Oligonucleotide
  source 1..30: mol_type = other RNA

SEQ ID NO: 810 - RNA, 30 nt, synthetic construct; identical to SEQ ID NO: 340
  misc_feature 1..30: note = Synthetic Oligonucleotide
  source 1..30: mol_type = other RNA

SEQ ID NO: 811 - RNA, 30 nt, synthetic construct; identical to SEQ ID NO: 341
  misc_feature 1..30: note = Synthetic Oligonucleotide
  source 1..30: mol_type = other RNA

SEQ ID NO: 812 - RNA, 30 nt, synthetic construct; identical to SEQ ID NO: 342
  misc_feature 1..30: note = Synthetic Oligonucleotide
  source 1..30: mol_type = other RNA

SEQ ID NO: 813 - RNA, 30 nt, synthetic construct; identical to SEQ ID NO: 343
  misc_feature 1..30: note = Synthetic Oligonucleotide
  source 1..30: mol_type = other RNA

SEQ ID NO: 814 - RNA, 30 nt, synthetic construct; identical to SEQ ID NO: 344
  misc_feature 1..30: note = Synthetic Oligonucleotide
  source 1..30: mol_type = other RNA

SEQ ID NO: 815 - RNA, 30 nt, synthetic construct; identical to SEQ ID NO: 345
  misc_feature 1..30: note = Synthetic Oligonucleotide
  source 1..30: mol_type = other RNA

SEQ ID NO: 816 - RNA, 30 nt, synthetic construct; identical to SEQ ID NO: 346
  misc_feature 1..30: note = Synthetic Oligonucleotide
  source 1..30: mol_type = other RNA

SEQ ID NO: 817 - RNA, 31 nt, synthetic construct; identical to SEQ ID NO: 347
  misc_feature 1..31: note = Synthetic Oligonucleotide
  source 1..31: mol_type = other RNA

SEQ ID NO: 818 - RNA, 31 nt, synthetic construct; identical to SEQ ID NO: 348
  misc_feature 1..31: note = Synthetic Oligonucleotide
  source 1..31: mol_type = other RNA

SEQ ID NO: 819 - RNA, 31 nt, synthetic construct; identical to SEQ ID NO: 349
  misc_feature 1..31: note = Synthetic Oligonucleotide
  source 1..31: mol_type = other RNA

SEQ ID NO: 820 - RNA, 31 nt, synthetic construct; identical to SEQ ID NO: 350
  misc_feature 1..31: note = Synthetic Oligonucleotide
  source 1..31: mol_type = other RNA

SEQ ID NO: 821 - RNA, 31 nt, synthetic construct; identical to SEQ ID NO: 351
  misc_feature 1..31: note = Synthetic Oligonucleotide
  source 1..31: mol_type = other RNA

SEQ ID NO: 822 - RNA, 51 nt, synthetic construct; identical to SEQ ID NO: 352
  misc_feature 1..51: note = Synthetic Oligonucleotide
  source 1..51: mol_type = other RNA

SEQ ID NO: 823 - RNA, 31 nt, synthetic construct; identical to SEQ ID NO: 353
  misc_feature 1..31: note = Synthetic Oligonucleotide
  source 1..31: mol_type = other RNA

SEQ ID NO: 824 - RNA, 31 nt, synthetic construct; identical to SEQ ID NO: 354
  misc_feature 1..31: note = Synthetic Oligonucleotide
  source 1..31: mol_type = other RNA

SEQ ID NO: 825 - RNA, 31 nt, synthetic construct; identical to SEQ ID NO: 355
  misc_feature 1..31: note = Synthetic Oligonucleotide
  source 1..31: mol_type = other RNA

SEQ ID NO: 826 - RNA, 31 nt, synthetic construct; identical to SEQ ID NO: 356
  misc_feature 1..31: note = Synthetic Oligonucleotide
  source 1..31: mol_type = other RNA

SEQ ID NO: 827 - RNA, 31 nt, synthetic construct; identical to SEQ ID NO: 357
  misc_feature 1..31: note = Synthetic Oligonucleotide
  source 1..31: mol_type = other RNA

SEQ ID NO: 828 - RNA, 31 nt, synthetic construct; identical to SEQ ID NO: 358
  misc_feature 1..31: note = Synthetic Oligonucleotide
  source 1..31: mol_type = other RNA

SEQ ID NO: 829 - RNA, 31 nt, synthetic construct; identical to SEQ ID NO: 359
  misc_feature 1..31: note = Synthetic Oligonucleotide
  source 1..31: mol_type = other RNA

SEQ ID NO: 830 - RNA, 31 nt, synthetic construct; identical to SEQ ID NO: 360
  misc_feature 1..31: note = Synthetic Oligonucleotide
  source 1..31: mol_type = other RNA

SEQ ID NO: 831 - RNA, 31 nt, synthetic construct; identical to SEQ ID NO: 361
  misc_feature 1..31: note = Synthetic Oligonucleotide
  source 1..31: mol_type = other RNA

SEQ ID NO: 832 - RNA, 31 nt, synthetic construct; identical to SEQ ID NO: 362
  misc_feature 1..31: note = Synthetic Oligonucleotide
  source 1..31: mol_type = other RNA

SEQ ID NO: 833 - RNA, 31 nt, synthetic construct; identical to SEQ ID NO: 363
  misc_feature 1..31: note = Synthetic Oligonucleotide
  source 1..31: mol_type = other RNA

SEQ ID NO: 834 - RNA, 31 nt, synthetic construct; identical to SEQ ID NO: 364
  misc_feature 1..31: note = Synthetic Oligonucleotide
  source 1..31: mol_type = other RNA

SEQ ID NO: 835 - RNA, 31 nt, synthetic construct; identical to SEQ ID NO: 365
  misc_feature 1..31: note = Synthetic Oligonucleotide
  source 1..31: mol_type = other RNA

SEQ ID NO: 836 - RNA, 31 nt, synthetic construct; identical to SEQ ID NO: 366
  misc_feature 1..31: note = Synthetic Oligonucleotide
  source 1..31: mol_type = other RNA

SEQ ID NO: 837 - RNA, 31 nt, synthetic construct; identical to SEQ ID NO: 367
  misc_feature 1..31: note = Synthetic Oligonucleotide
  source 1..31: mol_type = other RNA

SEQ ID NO: 838 - RNA, 51 nt, synthetic construct; identical to SEQ ID NO: 368
  misc_feature 1..51: note = Synthetic Oligonucleotide
  source 1..51: mol_type = other RNA

SEQ ID NO: 839 - RNA, 51 nt, synthetic construct; identical to SEQ ID NO: 369
  misc_feature 1..51: note = Synthetic Oligonucleotide
  source 1..51: mol_type = other RNA

SEQ ID NO: 840 - RNA, 51 nt, synthetic construct; identical to SEQ ID NO: 370
  misc_feature 1..51: note = Synthetic Oligonucleotide
  source 1..51: mol_type = other RNA

SEQ ID NO: 841 - RNA, 51 nt, synthetic construct; identical to SEQ ID NO: 371
  misc_feature 1..51: note = Synthetic Oligonucleotide
  source 1..51: mol_type = other RNA

SEQ ID NO: 842 - RNA, 51 nt, synthetic construct; identical to SEQ ID NO: 372
  misc_feature 1..51: note = Synthetic Oligonucleotide
  source 1..51: mol_type = other RNA

SEQ ID NO: 843 - RNA, 51 nt, synthetic construct; identical to SEQ ID NO: 373
  misc_feature 1..51: note = Synthetic Oligonucleotide
  source 1..51: mol_type = other RNA

SEQ ID NO: 844 - RNA, 51 nt, synthetic construct; identical to SEQ ID NO: 374
  misc_feature 1..51: note = Synthetic Oligonucleotide
  source 1..51: mol_type = other RNA

SEQ ID NO: 845 - RNA, 51 nt, synthetic construct
  misc_feature 1..51: note = Synthetic Oligonucleotide
  source 1..51: mol_type = other RNA
gcatcttgggcgtgctattgatgtgggacaggcagatcagacagcccctgg

SEQ ID NO: 846 - RNA, 51 nt, synthetic construct
  misc_feature 1..51: note = Synthetic Oligonucleotide
  source 1..51: mol_type = other RNA
gttcatcttgggcgtgctattgatgtgggacaggcagatcagacagcccct

SEQ ID NO: 847 - RNA, 51 nt, synthetic construct
  misc_feature 1..51: note = Synthetic Oligonucleotide
  source 1..51: mol_type = other RNA
gtcttcatcttgggcgtgctattgatgtgggacaggcagatcagacagccc

SEQ ID NO: 848 - RNA, 51 nt, synthetic construct
  misc_feature 1..51: note = Synthetic Oligonucleotide
  source 1..51: mol_type = other RNA
gcttcttcatcttgggcgtgctattgatgtgggacaggcagatcagacagc

SEQ ID NO: 849 - RNA, 51 nt, synthetic construct
  misc_feature 1..51: note = Synthetic Oligonucleotide
  source 1..51: mol_type = other RNA
gaacttcttcatcttgggcgtgctattgatgtgggacaggcagatcagaca

SEQ ID NO: 850 - RNA, 51 nt, synthetic construct
  misc_feature 1..51: note = Synthetic Oligonucleotide
  source 1..51: mol_type = other RNA
gtgaacttcttcatcttgggcgtgctattgatgtgggacaggcagatcaga

SEQ ID NO: 851 - RNA, 51 nt, synthetic construct
  misc_feature 1..51: note = Synthetic Oligonucleotide
  source 1..51: mol_type = other RNA
ggatgaacttcttcatcttgggcgtgctattgatgtgggacaggcagatca

SEQ ID NO: 852 - RNA, 51 nt, synthetic construct
  misc_feature 1..51: note = Synthetic Oligonucleotide
  source 1..51: mol_type = other RNA
ggggatgaacttcttcatcttgggcgtgctattgatgtgggacaggcagat

SEQ ID NO: 853 - RNA, 51 nt, synthetic construct
  misc_feature 1..51: note = Synthetic Oligonucleotide
  source 1..51: mol_type = other RNA
gctgggatgaacttcttcatcttgggcgtgctattgatgtgggacaggcag

SEQ ID NO: 854 - RNA, 51 nt, synthetic construct
  misc_feature 1..51: note = Synthetic Oligonucleotide
  source 1..51: mol_type = other RNA
gtcctgggatgaacttcttcatcttgggcgtgctattgatgtgggacaggc

SEQ ID NO: 855 - RNA, 51 nt, synthetic construct
  misc_feature 1..51: note = Synthetic Oligonucleotide
  source 1..51: mol_type = other RNA
gcgtcctgggatgaacttcttcatcttgggcgtgctattgatgtgggacag

SEQ ID NO: 856 - RNA, 51 nt, synthetic construct
  misc_feature 1..51: note = Synthetic Oligonucleotide
  source 1..51: mol_type = other RNA
gagcgtcctgggatgaacttcttcatcttgggcgtgctattgatgtgggac

SEQ ID NO: 857 - RNA, 51 nt, synthetic construct
  misc_feature 1..51: note = Synthetic Oligonucleotide
  source 1..51: mol_type = other RNA
ggcagcgtcctgggatgaacttcttcatcttgggcgtgctattgatgtggg

SEQ ID NO: 858 - RNA, 51 nt, synthetic construct
  misc_feature 1..51: note = Synthetic Oligonucleotide
  source 1..51: mol_type = other RNA
gtggcagcgtcctgggatgaacttcttcatcttgggcgtgctattgatgtg

SEQ ID NO: 859 - RNA, 51 nt, synthetic construct
  misc_feature 1..51: note = Synthetic Oligonucleotide
  source 1..51: mol_type = other RNA
gtgtggcagcgtcctgggatgaacttcttcatcttgggcgtgctattgatg

SEQ ID NO: 860 - RNA, 51 nt, synthetic construct
  misc_feature 1..51: note = Synthetic Oligonucleotide
  source 1..51: mol_type = other RNA
gggtgtggcagcgtcctgggatgaacttcttcatcttgggcgtgctattga

SEQ ID NO: 861 - RNA, 51 nt, synthetic construct
  misc_feature 1..51: note = Synthetic Oligonucleotide
  source 1..51: mol_type = other RNA
gtaggtgtggcagcgtcctgggatgaacttcttcatcttgggcgtgctatt

SEQ ID NO: 862 - RNA, 51 nt, synthetic construct
  misc_feature 1..51: note = Synthetic Oligonucleotide
  source 1..51: mol_type = other RNA
gcgtaggtgtggcagcgtcctgggatgaacttcttcatcttgggcgtgcta

SEQ ID NO: 863 - RNA, 30 nt, synthetic construct
  misc_feature 1..30: note = Synthetic Oligonucleotide
  source 1..30: mol_type = other RNA
gtgaaattgatgtgggacaggcagatcaga

SEQ ID NO: 864 - RNA, 30 nt, synthetic construct
  misc_feature 1..30: note = Synthetic Oligonucleotide
  source 1..30: mol_type = other RNA
gtgcaattgatgtgggacaggcagatcaga

SEQ ID NO: 865 - RNA, 30 nt, synthetic construct
  misc_feature 1..30: note = Synthetic Oligonucleotide
  source 1..30: mol_type = other RNA
gtggaattgatgtgggacaggcagatcaga

SEQ ID NO: 866 - RNA, 30 nt, synthetic construct
  misc_feature 1..30: note = Synthetic Oligonucleotide
  source 1..30: mol_type = other RNA
gtgtaattgatgtgggacaggcagatcaga

SEQ ID NO: 867 - RNA, 30 nt, synthetic construct
  misc_feature 1..30: note = Synthetic Oligonucleotide
  source 1..30: mol_type = other RNA
gtgaatttgatgtgggacaggcagatcaga

SEQ ID NO: 868 - RNA, 30 nt, synthetic construct
  misc_feature 1..30: note = Synthetic Oligonucleotide
  source 1..30: mol_type = other RNA
gtgcatttgatgtgggacaggcagatcaga

SEQ ID NO: 869 - RNA, 30 nt, synthetic construct
  misc_feature 1..30: note = Synthetic Oligonucleotide
  source 1..30: mol_type = other RNA
gtggatttgatgtgggacaggcagatcaga

SEQ ID NO: 870 - RNA, 30 nt, synthetic construct
  misc_feature 1..30: note = Synthetic Oligonucleotide
  source 1..30: mol_type = other RNA
gtgtatttgatgtgggacaggcagatcaga

SEQ ID NO: 871 - RNA, 30 nt, synthetic construct
  misc_feature 1..30: note = Synthetic Oligonucleotide
  source 1..30: mol_type = other RNA
gtgaacttgatgtgggacaggcagatcaga

SEQ ID NO: 872 - RNA, 30 nt, synthetic construct
  misc_feature 1..30: note = Synthetic Oligonucleotide
  source 1..30: mol_type = other RNA
gtgcacttgatgtgggacaggcagatcaga

SEQ ID NO: 873 - RNA, 30 nt, synthetic construct
  misc_feature 1..30: note = Synthetic Oligonucleotide
  source 1..30: mol_type = other RNA
gtggacttgatgtgggacaggcagatcaga

SEQ ID NO: 874 - RNA, 30 nt, synthetic construct
  misc_feature 1..30: note = Synthetic Oligonucleotide
  source 1..30: mol_type = other RNA
gtgtacttgatgtgggacaggcagatcaga

SEQ ID NO: 875 - RNA, 30 nt, synthetic construct
  misc_feature 1..30: note = Synthetic Oligonucleotide
  source 1..30: mol_type = other RNA
gtgaagttgatgtgggacaggcagatcaga

SEQ ID NO: 876 - RNA, 30 nt, synthetic construct
  misc_feature 1..30: note = Synthetic Oligonucleotide
  source 1..30: mol_type = other RNA
gtgcagttgatgtgggacaggcagatcaga

SEQ ID NO: 877 - RNA, 30 nt, synthetic construct
  misc_feature 1..30: note = Synthetic Oligonucleotide
  source 1..30: mol_type = other RNA
gtggagttgatgtgggacaggcagatcaga

SEQ ID NO: 878 - RNA, 30 nt, synthetic construct
  misc_feature 1..30: note = Synthetic Oligonucleotide
  source 1..30: mol_type = other RNA
gtgtagttgatgtgggacaggcagatcaga

SEQ ID NO: 879 - RNA, 30 nt, synthetic construct
  misc_feature 1..30: note = Synthetic Oligonucleotide
  source 1..30: mol_type = other RNA
gtgagattgatgtgggacaggcagatcaga

SEQ ID NO: 880 - RNA, 30 nt, synthetic construct
  misc_feature 1..30: note = Synthetic Oligonucleotide
  source 1..30: mol_type = other RNA
gtgcgattgatgtgggacaggcagatcaga

SEQ ID NO: 881 - RNA, 30 nt, synthetic construct
  misc_feature 1..30: note = Synthetic Oligonucleotide
  source 1..30: mol_type = other RNA
gtgggattgatgtgggacaggcagatcaga

SEQ ID NO: 882 - RNA, 30 nt, synthetic construct
  misc_feature 1..30: note = Synthetic Oligonucleotide
  source 1..30: mol_type = other RNA
gtgtgattgatgtgggacaggcagatcaga

SEQ ID NO: 883 - RNA, 30 nt, synthetic construct
  misc_feature 1..30: note = Synthetic Oligonucleotide
  source 1..30: mol_type = other RNA
gtgagtttgatgtgggacaggcagatcaga

SEQ ID NO: 884 - RNA, 30 nt, synthetic construct
  misc_feature 1..30: note = Synthetic Oligonucleotide
  source 1..30: mol_type = other RNA
gtgcgtttgatgtgggacaggcagatcaga

SEQ ID NO: 885 - RNA, 30 nt, synthetic construct
  misc_feature 1..30: note = Synthetic Oligonucleotide
  source 1..30: mol_type = other RNA
gtgggtttgatgtgggacaggcagatcaga

SEQ ID NO: 886 - RNA, 30 nt, synthetic construct
  misc_feature 1..30: note = Synthetic Oligonucleotide
  source 1..30: mol_type = other RNA
gtgtgtttgatgtgggacaggcagatcaga

SEQ ID NO: 887 - RNA, 30 nt, synthetic construct
  misc_feature 1..30: note = Synthetic Oligonucleotide
  source 1..30: mol_type = other RNA
gtgagcttgatgtgggacaggcagatcaga

SEQ ID NO: 888 - RNA, 30 nt, synthetic construct
  misc_feature 1..30: note = Synthetic Oligonucleotide
  source 1..30: mol_type = other RNA
gtgcgcttgatgtgggacaggcagatcaga

SEQ ID NO: 889 - RNA, 30 nt, synthetic construct
  misc_feature 1..30: note = Synthetic Oligonucleotide
  source 1..30: mol_type = other RNA
gtgggcttgatgtgggacaggcagatcaga

SEQ ID NO: 890 - RNA, 30 nt, synthetic construct
  misc_feature 1..30: note = Synthetic Oligonucleotide
  source 1..30: mol_type = other RNA
gtgtgcttgatgtgggacaggcagatcaga

SEQ ID NO: 891 - RNA, 30 nt, synthetic construct
  misc_feature 1..30: note = Synthetic Oligonucleotide
  source 1..30: mol_type = other RNA
gtgaggttgatgtgggacaggcagatcaga

SEQ ID NO: 892 - RNA, 30 nt, synthetic construct
  misc_feature 1..30: note = Synthetic Oligonucleotide
  source 1..30: mol_type = other RNA
gtgcggttgatgtgggacaggcagatcaga

SEQ ID NO: 893 - RNA, 30 nt, synthetic construct
  misc_feature 1..30: note = Synthetic Oligonucleotide
  source 1..30: mol_type = other RNA
gtggggttgatgtgggacaggcagatcaga

SEQ ID NO: 894 - RNA, 30 nt, synthetic construct
  misc_feature 1..30: note = Synthetic Oligonucleotide
  source 1..30: mol_type = other RNA
gtgtggttgatgtgggacaggcagatcaga

SEQ ID NO: 895 - RNA, 31 nt, synthetic construct
  misc_feature 1..31: note = Synthetic Oligonucleotide
  source 1..31: mol_type = other RNA
gtgttgatgtgggacaggcagatcagacagc

SEQ ID NO: 896 - RNA, 31 nt, synthetic construct
  misc_feature 1..31: note = Synthetic Oligonucleotide
  source 1..31: mol_type = other RNA
ggctgttgatgtgggacaggcagatcagaca

SEQ ID NO: 897 - RNA, 31 nt, synthetic construct
  misc_feature 1..31: note = Synthetic Oligonucleotide
  source 1..31: mol_type = other RNA
ggtgctgttgatgtgggacaggcagatcaga

SEQ ID NO: 898 - RNA, 31 nt, synthetic construct
  misc_feature 1..31: note = Synthetic Oligonucleotide
  source 1..31: mol_type = other RNA
ggcgtgctgttgatgtgggacaggcagatca

SEQ ID NO: 899 - RNA, 31 nt, synthetic construct
  misc_feature 1..31: note = Synthetic Oligonucleotide
  source 1..31: mol_type = other RNA
ggggcgtgctgttgatgtgggacaggcagat

SEQ ID NO: 900 - RNA, 31 nt, synthetic construct
  misc_feature 1..31: note = Synthetic Oligonucleotide
  source 1..31: mol_type = other RNA
gttgggcgtgctgttgatgtgggacaggcag

SEQ ID NO: 901 - RNA, 31 nt, synthetic construct
  misc_feature 1..31: note = Synthetic Oligonucleotide
  source 1..31: mol_type = other RNA
gtcttgggcgtgctgttgatgtgggacaggc

SEQ ID NO: 902 - RNA, 31 nt, synthetic construct
  misc_feature 1..31: note = Synthetic Oligonucleotide
  source 1..31: mol_type = other RNA
gcatcttgggcgtgctgttgatgtgggacag

SEQ ID NO: 903 - RNA, 31 nt, synthetic construct
  misc_feature 1..31: note = Synthetic Oligonucleotide
  source 1..31: mol_type = other RNA
gttcatcttgggcgtgctgttgatgtgggac

SEQ ID NO: 904 - RNA, 31 nt, synthetic construct
  misc_feature 1..31: note = Synthetic Oligonucleotide
  source 1..31: mol_type = other RNA
gtcttcatcttgggcgtgctgttgatgtggg

SEQ ID NO: 905 - RNA, 31 nt, synthetic construct
  misc_feature 1..31: note = Synthetic Oligonucleotide
  source 1..31: mol_type = other RNA
gcttcttcatcttgggcgtgctgttgatgtg

SEQ ID NO: 906 - RNA, 31 nt, synthetic construct
  misc_feature 1..31: note = Synthetic Oligonucleotide
  source 1..31: mol_type = other RNA
gaacttcttcatcttgggcgtgctgttgatg

SEQ ID NO: 907 - RNA, 31 nt, synthetic construct
  misc_feature 1..31: note = Synthetic Oligonucleotide
  source 1..31: mol_type = other RNA
gtgaacttcttcatcttgggcgtgctgttga

SEQ ID NO: 908 - RNA, 31 nt, synthetic construct
  misc_feature 1..31: note = Synthetic Oligonucleotide
  source 1..31: mol_type = other RNA
ggatgaacttcttcatcttgggcgtgctgtt

SEQ ID NO: 909 - RNA, 31 nt, synthetic construct
  misc_feature 1..31: note = Synthetic Oligonucleotide
  source 1..31: mol_type = other RNA
ggggatgaacttcttcatcttgggcgtgctg

SEQ ID NO: 910 - RNA, 31 nt, synthetic construct; identical to SEQ ID NO: 375
  misc_feature 1..31: note = Synthetic Oligonucleotide
  source 1..31: mol_type = other RNA

SEQ ID NO: 911 - RNA, 31 nt, synthetic construct; identical to SEQ ID NO: 376
  misc_feature 1..31: note = Synthetic Oligonucleotide
  source 1..31: mol_type = other RNA

SEQ ID NO: 912 - RNA, 31 nt, synthetic construct; identical to SEQ ID NO: 377
  misc_feature 1..31: note = Synthetic Oligonucleotide
  source 1..31: mol_type = other RNA

SEQ ID NO: 913 - RNA, 31 nt, synthetic construct; identical to SEQ ID NO: 378
  misc_feature 1..31: note = Synthetic Oligonucleotide
  source 1..31: mol_type = other RNA

SEQ ID NO: 914 - RNA, 31 nt, synthetic construct; identical to SEQ ID NO: 379
  misc_feature 1..31: note = Synthetic Oligonucleotide
  source 1..31: mol_type = other RNA

SEQ ID NO: 915 - RNA, 31 nt, synthetic construct; identical to SEQ ID NO: 380
  misc_feature 1..31: note = Synthetic Oligonucleotide
  source 1..31: mol_type = other RNA

SEQ ID NO: 916 - RNA, 31 nt, synthetic construct; identical to SEQ ID NO: 381
  misc_feature 1..31: note = Synthetic Oligonucleotide
  source 1..31: mol_type = other RNA

SEQ ID NO: 917 - RNA, 31 nt, synthetic construct; identical to SEQ ID NO: 382
  misc_feature 1..31: note = Synthetic Oligonucleotide
  source 1..31: mol_type = other RNA

SEQ ID NO: 918 - RNA, 31 nt, synthetic construct; identical to SEQ ID NO: 383
  misc_feature 1..31: note = Synthetic Oligonucleotide
  source 1..31: mol_type = other RNA

SEQ ID NO: 919 - RNA, 31 nt, synthetic construct; identical to SEQ ID NO: 384
  misc_feature 1..31: note = Synthetic Oligonucleotide
  source 1..31: mol_type = other RNA

SEQ ID NO: 920 - RNA, 31 nt, synthetic construct; identical to SEQ ID NO: 385
  misc_feature 1..31: note = Synthetic Oligonucleotide
  source 1..31: mol_type = other RNA

SEQ ID NO: 921 - RNA, 31 nt, synthetic construct; identical to SEQ ID NO: 386
  misc_feature 1..31: note = Synthetic Oligonucleotide
  source 1..31: mol_type = other RNA

SEQ ID NO: 922 - RNA, 31 nt, synthetic construct; identical to SEQ ID NO: 387
  misc_feature 1..31: note = Synthetic Oligonucleotide
  source 1..31: mol_type = other RNA

SEQ ID NO: 923 - RNA, 31 nt, synthetic construct; identical to SEQ ID NO: 388
  misc_feature 1..31: note = Synthetic Oligonucleotide
  source 1..31: mol_type = other RNA

SEQ ID NO: 924 - RNA, 31 nt, synthetic construct; identical to SEQ ID NO: 389
  misc_feature 1..31: note = Synthetic Oligonucleotide
  source 1..31: mol_type = other RNA

SEQ ID NO: 925 - RNA, 31 nt, synthetic construct; identical to SEQ ID NO: 390
  misc_feature 1..31: note = Synthetic Oligonucleotide
  source 1..31: mol_type = other RNA

SEQ ID NO: 926 - RNA, 31 nt, synthetic construct; identical to SEQ ID NO: 391
  misc_feature 1..31: note = Synthetic Oligonucleotide
  source 1..31: mol_type = other RNA

SEQ ID NO: 927 - RNA, 31 nt, synthetic construct; identical to SEQ ID NO: 392
  misc_feature 1..31: note = Synthetic Oligonucleotide
  source 1..31: mol_type = other RNA

SEQ ID NO: 928 - RNA, 31 nt, synthetic construct; identical to SEQ ID NO: 393
  misc_feature 1..31: note = Synthetic Oligonucleotide
  source 1..31: mol_type = other RNA

SEQ ID NO: 929 - RNA, 31 nt, synthetic construct; identical to SEQ ID NO: 394
  misc_feature 1..31: note = Synthetic Oligonucleotide
  source 1..31: mol_type = other RNA

SEQ ID NO: 930 - RNA, 31 nt, synthetic construct; identical to SEQ ID NO: 395
  misc_feature 1..31: note = Synthetic Oligonucleotide
  source 1..31: mol_type = other RNA

SEQ ID NO: 931 - RNA, 31 nt, synthetic construct; identical to SEQ ID NO: 396
  misc_feature 1..31: note = Synthetic Oligonucleotide
  source 1..31: mol_type = other RNA

SEQ ID NO: 932 - RNA, 31 nt, synthetic construct; identical to SEQ ID NO: 397
  misc_feature 1..31: note = Synthetic Oligonucleotide
  source 1..31: mol_type = other RNA

SEQ ID NO: 933 - RNA, 31 nt, synthetic construct; identical to SEQ ID NO: 398
  misc_feature 1..31: note = Synthetic Oligonucleotide
  source 1..31: mol_type = other RNA

SEQ ID NO: 934 - RNA, 31 nt, synthetic construct; identical to SEQ ID NO: 403
  misc_feature 1..31: note = Synthetic Oligonucleotide
  source 1..31: mol_type = other RNA

SEQ ID NO: 935 - RNA, 31 nt, synthetic construct; identical to SEQ ID NO: 404
  misc_feature 1..31: note = Synthetic Oligonucleotide
  source 1..31: mol_type = other RNA

SEQ ID NO: 936 - RNA, 31 nt, synthetic construct; identical to SEQ ID NO: 405
  misc_feature 1..31: note = Synthetic Oligonucleotide
  source 1..31: mol_type = other RNA

SEQ ID NO: 937 - RNA, 31 nt, synthetic construct; identical to SEQ ID NO: 406
  misc_feature 1..31: note = Synthetic Oligonucleotide
  source 1..31: mol_type = other RNA

SEQ ID NO: 938 - RNA, 31 nt, synthetic construct; identical to SEQ ID NO: 407
  misc_feature 1..31: note = Synthetic Oligonucleotide
  source 1..31: mol_type = other RNA

SEQ ID NO: 939 - RNA, 31 nt, synthetic construct; identical to SEQ ID NO: 376
  misc_feature 1..31: note = Synthetic Oligonucleotide
  source 1..31: mol_type = other RNA

SEQ ID NO: 940 - RNA, 31 nt, synthetic construct; identical to SEQ ID NO: 409
  misc_feature 1..31: note = Synthetic Oligonucleotide
  source 1..31: mol_type = other RNA

SEQ ID NO: 941 - RNA, 31 nt, synthetic construct; identical to SEQ ID NO: 410
  misc_feature 1..31: note = Synthetic Oligonucleotide
  source 1..31: mol_type = other RNA

SEQ ID NO: 942 - RNA, 31 nt, synthetic construct; identical to SEQ ID NO: 411
  misc_feature 1..31: note = Synthetic Oligonucleotide
  source 1..31: mol_type = other RNA

SEQ ID NO: 943 - RNA, 31 nt, synthetic construct; identical to SEQ ID NO: 377
  misc_feature 1..31: note = Synthetic Oligonucleotide
  source 1..31: mol_type = other RNA

SEQ ID NO: 944 - RNA, 31 nt, synthetic construct; identical to SEQ ID NO: 413
  misc_feature 1..31: note = Synthetic Oligonucleotide
  source 1..31: mol_type = other RNA

SEQ ID NO: 945 - RNA, 31 nt, synthetic construct; identical to SEQ ID NO: 414
  misc_feature 1..31: note = Synthetic Oligonucleotide
  source 1..31: mol_type = other RNA

SEQ ID NO: 946 - RNA, 31 nt, synthetic construct; identical to SEQ ID NO: 415
  misc_feature 1..31: note = Synthetic Oligonucleotide
  source 1..31: mol_type = other RNA

SEQ ID NO: 947 - RNA, 31 nt, synthetic construct; identical to SEQ ID NO: 416
  misc_feature 1..31: note = Synthetic Oligonucleotide
  source 1..31: mol_type = other RNA

SEQ ID NO: 948 - RNA, 31 nt, synthetic construct; identical to SEQ ID NO: 378
  misc_feature 1..31: note = Synthetic Oligonucleotide
  source 1..31: mol_type = other RNA

SEQ ID NO: 949 - RNA, 31 nt, synthetic construct; identical to SEQ ID NO: 418
  misc_feature 1..31: note = Synthetic Oligonucleotide
  source 1..31: mol_type = other RNA

SEQ ID NO: 950 - RNA, 31 nt, synthetic construct; identical to SEQ ID NO: 419
  misc_feature 1..31: note = Synthetic Oligonucleotide
  source 1..31: mol_type = other RNA

SEQ ID NO: 951 - RNA, 31 nt, synthetic construct; identical to SEQ ID NO: 420
  misc_feature 1..31: note = Synthetic Oligonucleotide
  source 1..31: mol_type = other RNA

SEQ ID NO: 952 - RNA, 31 nt, synthetic construct; identical to SEQ ID NO: 421
  misc_feature 1..31: note = Synthetic Oligonucleotide
  source 1..31: mol_type = other RNA

SEQ ID NO: 953 - RNA, 31 nt, synthetic construct; identical to SEQ ID NO: 422
  misc_feature 1..31: note = Synthetic Oligonucleotide
  source 1..31: mol_type = other RNA

SEQ ID NO: 954 - RNA, 31 nt, synthetic construct; identical to SEQ ID NO: 423
  misc_feature 1..31: note = Synthetic Oligonucleotide
  source 1..31: mol_type = other RNA

SEQ ID NO: 955 - RNA, 31 nt, synthetic construct; identical to SEQ ID NO: 424
  misc_feature 1..31: note = Synthetic Oligonucleotide
  source 1..31: mol_type = other RNA

SEQ ID NO: 956 - RNA, 31 nt, synthetic construct; identical to SEQ ID NO: 380
  misc_feature 1..31: note = Synthetic Oligonucleotide
  source 1..31: mol_type = other RNA

SEQ ID NO: 957 - RNA, 31 nt, synthetic construct; identical to SEQ ID NO: 426
  misc_feature 1..31: note = Synthetic Oligonucleotide
  source 1..31: mol_type = other RNA

SEQ ID NO: 958 - RNA, 31 nt, synthetic construct; identical to SEQ ID NO: 427
  misc_feature 1..31: note = Synthetic Oligonucleotide
  source 1..31: mol_type = other RNA

SEQ ID NO: 959 - RNA, 31 nt, synthetic construct; identical to SEQ ID NO: 428
  misc_feature 1..31: note = Synthetic Oligonucleotide
  source 1..31: mol_type = other RNA

SEQ ID NO: 960 - RNA, 31 nt, synthetic construct; identical to SEQ ID NO: 429
  misc_feature 1..31: note = Synthetic Oligonucleotide
  source 1..31: mol_type = other RNA

SEQ ID NO: 961 - RNA, 31 nt, synthetic construct; identical to SEQ ID NO: 430
  misc_feature 1..31: note = Synthetic Oligonucleotide
  source 1..31: mol_type = other RNA

SEQ ID NO: 962 - RNA, 31 nt, synthetic construct; identical to SEQ ID NO: 382
  misc_feature 1..31: note = Synthetic Oligonucleotide
  source 1..31: mol_type = other RNA

SEQ ID NO: 963 - RNA, 31 nt, synthetic construct; identical to SEQ ID NO: 432
  misc_feature 1..31: note = Synthetic Oligonucleotide
  source 1..31: mol_type = other RNA

SEQ ID NO: 964 - RNA, 31 nt, synthetic construct; identical to SEQ ID NO: 433
  misc_feature 1..31: note = Synthetic Oligonucleotide
  source 1..31: mol_type = other RNA

SEQ ID NO: 965 - RNA, 31 nt, synthetic construct; identical to SEQ ID NO: 434
  misc_feature 1..31: note = Synthetic Oligonucleotide
  source 1..31: mol_type = other RNA

SEQ ID NO: 966 - RNA, 31 nt, synthetic construct; identical to SEQ ID NO: 435
  misc_feature 1..31: note = Synthetic Oligonucleotide
  source 1..31: mol_type = other RNA

SEQ ID NO: 967 - RNA, 31 nt, synthetic construct; identical to SEQ ID NO: 436
  misc_feature 1..31: note = Synthetic Oligonucleotide
  source 1..31: mol_type = other RNA

SEQ ID NO: 968 - RNA, 31 nt, synthetic construct; identical to SEQ ID NO: 437
  misc_feature 1..31: note = Synthetic Oligonucleotide
  source 1..31: mol_type = other RNA

SEQ ID NO: 969 - RNA, 31 nt, synthetic construct; identical to SEQ ID NO: 438
  misc_feature 1..31: note = Synthetic Oligonucleotide
  source 1..31: mol_type = other RNA

SEQ ID NO: 970 - RNA, 31 nt, synthetic construct; identical to SEQ ID NO: 439
  misc_feature 1..31: note = Synthetic Oligonucleotide
  source 1..31: mol_type = other RNA

SEQ ID NO: 971 - RNA, 31 nt, synthetic construct; identical to SEQ ID NO: 440
  misc_feature 1..31: note = Synthetic Oligonucleotide
  source 1..31: mol_type = other RNA

SEQ ID NO: 972 - RNA, 31 nt, synthetic construct; identical to SEQ ID NO: 384
  misc_feature 1..31: note = Synthetic Oligonucleotide
  source 1..31: mol_type = other RNA

SEQ ID NO: 973 - RNA, 31 nt, synthetic construct; identical to SEQ ID NO: 442
  misc_feature 1..31: note = Synthetic Oligonucleotide
  source 1..31: mol_type = other RNA

SEQ ID NO: 974 - RNA, 31 nt, synthetic construct; identical to SEQ ID NO: 443
  misc_feature 1..31: note = Synthetic Oligonucleotide
  source 1..31: mol_type = other RNA

SEQ ID NO: 975 - RNA, 31 nt, synthetic construct; identical to SEQ ID NO: 444
  misc_feature 1..31: note = Synthetic Oligonucleotide
  source 1..31: mol_type = other RNA

SEQ ID NO: 976 - RNA, 31 nt, synthetic construct; identical to SEQ ID NO: 445
  misc_feature 1..31: note = Synthetic Oligonucleotide
  source 1..31: mol_type = other RNA

SEQ ID NO: 977 - RNA, 31 nt, synthetic construct; identical to SEQ ID NO: 446
  misc_feature 1..31: note = Synthetic Oligonucleotide
  source 1..31: mol_type = other RNA

SEQ ID NO: 978 - RNA, 31 nt, synthetic construct; identical to SEQ ID NO: 447
  misc_feature 1..31: note = Synthetic Oligonucleotide
  source 1..31: mol_type = other RNA

SEQ ID NO: 979 - RNA, 31 nt, synthetic construct; identical to SEQ ID NO: 448
  misc_feature 1..31: note = Synthetic Oligonucleotide
  source 1..31: mol_type = other RNA

SEQ ID NO: 980 - RNA, 31 nt, synthetic construct; identical to SEQ ID NO: 386
  misc_feature 1..31: note = Synthetic Oligonucleotide
  source 1..31: mol_type = other RNA

SEQ ID NO: 981 - RNA, 31 nt, synthetic construct; identical to SEQ ID NO: 450
  misc_feature 1..31: note = Synthetic Oligonucleotide
  source 1..31: mol_type = other RNA

SEQ ID NO: 982 - RNA, 31 nt, synthetic construct; identical to SEQ ID NO: 451
  misc_feature 1..31: note = Synthetic Oligonucleotide
  source 1..31: mol_type = other RNA

SEQ ID NO: 983 - RNA, 31 nt, synthetic construct; identical to SEQ ID NO: 452
  misc_feature 1..31: note = Synthetic Oligonucleotide
  source 1..31: mol_type = other RNA

SEQ ID NO: 984 - RNA, 31 nt, synthetic construct; identical to SEQ ID NO: 453
  misc_feature 1..31: note = Synthetic Oligonucleotide
  source 1..31: mol_type = other RNA

SEQ ID NO: 985 - RNA, 31 nt, synthetic construct; identical to SEQ ID NO: 454
  misc_feature 1..31: note = Synthetic Oligonucleotide
  source 1..31: mol_type = other RNA

SEQ ID NO: 986 - RNA, 31 nt, synthetic construct; identical to SEQ ID NO: 455
  misc_feature 1..31: note = Synthetic Oligonucleotide
  source 1..31: mol_type = other RNA

SEQ ID NO: 987 - RNA, 31 nt, synthetic construct; identical to SEQ ID NO: 456
  misc_feature 1..31: note = Synthetic Oligonucleotide
  source 1..31: mol_type = other RNA

SEQ ID NO: 988 - RNA, 31 nt, synthetic construct; identical to SEQ ID NO: 388
  misc_feature 1..31: note = Synthetic Oligonucleotide
  source 1..31: mol_type = other RNA

SEQ ID NO: 989 - RNA, 31 nt, synthetic construct; identical to SEQ ID NO: 458
  misc_feature 1..31: note = Synthetic Oligonucleotide
  source 1..31: mol_type = other RNA

SEQ ID NO: 990 - RNA, 31 nt, synthetic construct; identical to SEQ ID NO: 459
  misc_feature 1..31: note = Synthetic Oligonucleotide
  source 1..31: mol_type = other RNA

SEQ ID NO: 991 - RNA, 31 nt, synthetic construct; identical to SEQ ID NO: 460
  misc_feature 1..31: note = Synthetic Oligonucleotide
  source 1..31: mol_type = other RNA

SEQ ID NO: 992 - RNA, 31 nt, synthetic construct; identical to SEQ ID NO: 461
  misc_feature 1..31: note = Synthetic Oligonucleotide
  source 1..31: mol_type = other RNA

SEQ ID NO: 993 - RNA, 31 nt, synthetic construct; identical to SEQ ID NO: 462
  misc_feature 1..31: note = Synthetic Oligonucleotide
  source 1..31: mol_type = other RNA

SEQ ID NO: 994 - RNA, 31 nt, synthetic construct; identical to SEQ ID NO: 463
  misc_feature 1..31: note = Synthetic Oligonucleotide
  source 1..31: mol_type = other RNA

SEQ ID NO: 995 - RNA, 31 nt, synthetic construct; identical to SEQ ID NO: 390
  misc_feature 1..31: note = Synthetic Oligonucleotide
  source 1..31: mol_type = other RNA

SEQ ID NO: 996 - RNA, 31 nt, synthetic construct; identical to SEQ ID NO: 465
  misc_feature 1..31: note = Synthetic Oligonucleotide
  source 1..31: mol_type = other RNA

SEQ ID NO: 997 - RNA, 31 nt, synthetic construct; identical to SEQ ID NO: 466
  misc_feature 1..31: note = Synthetic Oligonucleotide
  source 1..31: mol_type = other RNA

SEQ ID NO: 998 - RNA, 31 nt, synthetic construct; identical to SEQ ID NO: 467
  misc_feature 1..31: note = Synthetic Oligonucleotide
  source 1..31: mol_type = other RNA

SEQ ID NO: 999 - RNA, 31 nt, synthetic construct; identical to SEQ ID NO: 468
  misc_feature 1..31: note = Synthetic Oligonucleotide
  source 1..31: mol_type = other RNA

SEQ ID NO: 1000 - RNA, 31 nt, synthetic construct; identical to SEQ ID NO: 391
  misc_feature 1..31: note = Synthetic Oligonucleotide
  source 1..31: mol_type = other RNA

SEQ ID NO: 1001 - RNA, 31 nt, synthetic construct; identical to SEQ ID NO: 470
  misc_feature 1..31: note = Synthetic Oligonucleotide
  source 1..31: mol_type = other RNA

SEQ ID NO: 1002 - RNA, 31 nt, synthetic construct; identical to SEQ ID NO: 471
  misc_feature 1..31: note = Synthetic Oligonucleotide
  source 1..31: mol_type = other RNA

SEQ ID NO: 1003 - RNA, 31 nt, synthetic construct; identical to SEQ ID NO: 472
  misc_feature 1..31: note = Synthetic Oligonucleotide
  source 1..31: mol_type = other RNA

SEQ ID NO: 1004 - RNA, 31 nt, synthetic construct; identical to SEQ ID NO: 473
  misc_feature 1..31: note = Synthetic Oligonucleotide
  source 1..31: mol_type = other RNA

SEQ ID NO: 1005 - RNA, 31 nt, synthetic construct; identical to SEQ ID NO: 474
  misc_feature 1..31: note = Synthetic Oligonucleotide
  source 1..31: mol_type = other RNA

SEQ ID NO: 1006 - RNA, 31 nt, synthetic construct; identical to SEQ ID NO: 475
  misc_feature 1..31: note = Synthetic Oligonucleotide
  source 1..31: mol_type = other RNA

SEQ ID NO: 1007 - RNA, 31 nt, synthetic construct; identical to SEQ ID NO: 476
  misc_feature 1..31: note = Synthetic Oligonucleotide
  source 1..31: mol_type = other RNA

SEQ ID NO: 1008 - RNA, 31 nt, synthetic construct; identical to SEQ ID NO: 393
  misc_feature 1..31: note = Synthetic Oligonucleotide
  source 1..31: mol_type = other RNA

SEQ ID NO: 1009 - RNA, 31 nt, synthetic construct; identical to SEQ ID NO: 478
  misc_feature 1..31: note = Synthetic Oligonucleotide
  source 1..31: mol_type = other RNA

SEQ ID NO: 1010 - RNA, 31 nt, synthetic construct; identical to SEQ ID NO: 479
  misc_feature 1..31: note = Synthetic Oligonucleotide
  source 1..31: mol_type = other RNA

SEQ ID NO: 1011 - RNA, 31 nt, synthetic construct; identical to SEQ ID NO: 375
  misc_feature 1..31: note = Synthetic Oligonucleotide
  source 1..31: mol_type = other RNA

SEQ ID NO: 1012 - RNA, 31 nt, synthetic construct; identical to SEQ ID NO: 481
  misc_feature 1..31: note = Synthetic Oligonucleotide
  source 1..31: mol_type = other RNA

SEQ ID NO: 1013 - RNA, 31 nt, synthetic construct; identical to SEQ ID NO: 482
  misc_feature 1..31: note = Synthetic Oligonucleotide
  source 1..31: mol_type = other RNA

SEQ ID NO: 1014 - RNA, 31 nt, synthetic construct; identical to SEQ ID NO: 483
  misc_feature 1..31: note = Synthetic Oligonucleotide
  source 1..31: mol_type = other RNA

SEQ ID NO: 1015 - RNA, 31 nt, synthetic construct; identical to SEQ ID NO: 484
  misc_feature 1..31: note = Synthetic Oligonucleotide
  source 1..31: mol_type = other RNA

SEQ ID NO: 1016 - RNA, 31 nt, synthetic construct; identical to SEQ ID NO: 485
  misc_feature 1..31: note = Synthetic Oligonucleotide
  source 1..31: mol_type = other RNA

SEQ ID NO: 1017 - RNA, 31 nt, synthetic construct; identical to SEQ ID NO: 486
  misc_feature 1..31: note = Synthetic Oligonucleotide
  source 1..31: mol_type = other RNA

SEQ ID NO: 1018 - RNA, 31 nt, synthetic construct; identical to SEQ ID NO: 487
  misc_feature 1..31: note = Synthetic Oligonucleotide
  source 1..31: mol_type = other RNA

SEQ ID NO: 1019 - RNA, 31 nt, synthetic construct; identical to SEQ ID NO: 488
  misc_feature 1..31: note = Synthetic Oligonucleotide
  source 1..31: mol_type = other RNA

SEQ ID NO: 1020 - RNA, 31 nt, synthetic construct; identical to SEQ ID NO: 489
  misc_feature 1..31: note = Synthetic Oligonucleotide
  source 1..31: mol_type = other RNA

SEQ ID NO: 1021 - RNA, 31 nt, synthetic construct; identical to SEQ ID NO: 490
  misc_feature 1..31: note = Synthetic Oligonucleotide
  source 1..31: mol_type = other RNA

SEQ ID NO: 1022 - RNA, 31 nt, synthetic construct; identical to SEQ ID NO: 491
  misc_feature 1..31: note = Synthetic Oligonucleotide
  source 1..31: mol_type = other RNA

SEQ ID NO: 1023 - RNA, 31 nt, synthetic construct; identical to SEQ ID NO: 492
  misc_feature 1..31: note = Synthetic Oligonucleotide
  source 1..31: mol_type = other RNA

SEQ ID NO: 1024 - RNA, 31 nt, synthetic construct; identical to SEQ ID NO: 493
  misc_feature 1..31: note = Synthetic Oligonucleotide
  source 1..31: mol_type = other RNA

SEQ ID NO: 1025 - RNA, 31 nt, synthetic construct; identical to SEQ ID NO: 494
  misc_feature 1..31: note = Synthetic Oligonucleotide
  source 1..31: mol_type = other RNA

SEQ ID NO: 1026 - RNA, 31 nt, synthetic construct; identical to SEQ ID NO: 495
  misc_feature 1..31: note = Synthetic Oligonucleotide
  source 1..31: mol_type = other RNA

SEQ ID NO: 1027 - RNA, 31 nt, synthetic construct; identical to SEQ ID NO: 379
  misc_feature 1..31: note = Synthetic Oligonucleotide
  source 1..31: mol_type = other RNA

SEQ ID NO: 1028 - RNA, 31 nt, synthetic construct; identical to SEQ ID NO: 497
  misc_feature 1..31: note = Synthetic Oligonucleotide
  source 1..31: mol_type = other RNA

SEQ ID NO: 1029 - RNA, 31 nt, synthetic construct; identical to SEQ ID NO: 498
  misc_feature 1..31: note = Synthetic Oligonucleotide
  source 1..31: mol_type = other RNA

SEQ ID NO: 1030 - RNA, 31 nt, synthetic construct; identical to SEQ ID NO: 499
  misc_feature 1..31: note = Synthetic Oligonucleotide
  source 1..31: mol_type = other RNA

SEQ ID NO: 1031 - RNA, 31 nt, synthetic construct; identical to SEQ ID NO: 500
  misc_feature 1..31: note = Synthetic Oligonucleotide
  source 1..31: mol_type = other RNA

SEQ ID NO: 1032 - RNA, 31 nt, synthetic construct; identical to SEQ ID NO: 501
  misc_feature 1..31: note = Synthetic Oligonucleotide
  source 1..31: mol_type = other RNA

SEQ ID NO: 1033 - RNA, 31 nt, synthetic construct; identical to SEQ ID NO: 502
  misc_feature 1..31: note = Synthetic Oligonucleotide
  source 1..31: mol_type = other RNA

SEQ ID NO: 1034 - RNA, 31 nt, synthetic construct; identical to SEQ ID NO: 503
  misc_feature 1..31: note = Synthetic Oligonucleotide
  source 1..31: mol_type = other RNA

SEQ ID NO: 1035 - RNA, 31 nt, synthetic construct; identical to SEQ ID NO: 504
  misc_feature 1..31: note = Synthetic Oligonucleotide
  source 1..31: mol_type = other RNA

SEQ ID NO: 1036 - RNA, 31 nt, synthetic construct; identical to SEQ ID NO: 381
  misc_feature 1..31: note = Synthetic Oligonucleotide
  source 1..31: mol_type = other RNA

SEQ ID NO: 1037 - RNA, 31 nt, synthetic construct; identical to SEQ ID NO: 506
  misc_feature 1..31: note = Synthetic Oligonucleotide
  source 1..31: mol_type = other RNA

SEQ ID NO: 1038 - RNA, 31 nt, synthetic construct; identical to SEQ ID NO: 507
  misc_feature 1..31: note = Synthetic Oligonucleotide
  source 1..31: mol_type = other RNA

SEQ ID NO: 1039 - RNA, 21 nt, synthetic construct
  misc_feature 1..21: note = Synthetic Oligonucleotide
  source 1..21: mol_type = other RNA
ggctgtgtccagaatatccaa

SEQ ID NO: 1040 - RNA, 31 nt, synthetic construct; identical to SEQ ID NO: 509
  misc_feature 1..31: note = Synthetic Oligonucleotide
  source 1..31: mol_type = other RNA

SEQ ID NO: 1041 - RNA, 31 nt, synthetic construct; identical to SEQ ID NO: 510
  misc_feature 1..31: note = Synthetic Oligonucleotide
  source 1..31: mol_type = other RNA

SEQ ID NO: 1042 - RNA, 31 nt, synthetic construct; identical to SEQ ID NO: 387
  misc_feature 1..31: note = Synthetic Oligonucleotide
  source 1..31: mol_type = other RNA

SEQ ID NO: 1043 - RNA, 31 nt, synthetic construct; identical to SEQ ID NO: 512
  misc_feature 1..31: note = Synthetic Oligonucleotide
  source 1..31: mol_type = other RNA

SEQ ID NO: 1044 - RNA, 31 nt, synthetic construct; identical to SEQ ID NO: 383
  misc_feature 1..31: note = Synthetic Oligonucleotide
  source 1..31: mol_type = other RNA

SEQ ID NO: 1045 - RNA, 31 nt, synthetic construct; identical to SEQ ID NO: 514
  misc_feature 1..31: note = Synthetic Oligonucleotide
  source 1..31: mol_type = other RNA

SEQ ID NO: 1046 - RNA, 31 nt, synthetic construct; identical to SEQ ID NO: 515
  misc_feature 1..31: note = Synthetic Oligonucleotide
  source 1..31: mol_type = other RNA

SEQ ID NO: 1047 - RNA, 31 nt, synthetic construct; identical to SEQ ID NO: 516
  misc_feature 1..31: note = Synthetic Oligonucleotide
  source 1..31: mol_type = other RNA

SEQ ID NO: 1048 - RNA, 31 nt, synthetic construct; identical to SEQ ID NO: 517
  misc_feature 1..31: note = Synthetic Oligonucleotide
  source 1..31: mol_type = other RNA

SEQ ID NO: 1049 - RNA, 31 nt, synthetic construct; identical to SEQ ID NO: 518
  misc_feature 1..31: note = Synthetic Oligonucleotide
  source 1..31: mol_type = other RNA

SEQ ID NO: 1050 - RNA, 31 nt, synthetic construct; identical to SEQ ID NO: 519
  misc_feature 1..31: note = Synthetic Oligonucleotide
  source 1..31: mol_type = other RNA

SEQ ID NO: 1051 - RNA, 31 nt, synthetic construct; identical to SEQ ID NO: 520
  misc_feature 1..31: note = Synthetic Oligonucleotide
  source 1..31: mol_type = other RNA

SEQ ID NO: 1052 - RNA, 31 nt, synthetic construct; identical to SEQ ID NO: 385
  misc_feature 1..31: note = Synthetic Oligonucleotide
  source 1..31: mol_type = other RNA

SEQ ID NO: 1053 - RNA, 31 nt, synthetic construct; identical to SEQ ID NO: 522
  misc_feature 1..31: note = Synthetic Oligonucleotide
  source 1..31: mol_type = other RNA

SEQ ID NO: 1054 - RNA, 31 nt, synthetic construct; identical to SEQ ID NO: 523
  misc_feature 1..31: note = Synthetic Oligonucleotide
  source 1..31: mol_type = other RNA

SEQ ID NO: 1055 - RNA, 31 nt, synthetic construct; identical to SEQ ID NO: 524
  misc_feature 1..31: note = Synthetic Oligonucleotide
  source 1..31: mol_type = other RNA

SEQ ID NO: 1056 - RNA, 31 nt, synthetic construct; identical to SEQ ID NO: 525
  misc_feature 1..31: note = Synthetic Oligonucleotide
  source 1..31: mol_type = other RNA

SEQ ID NO: 1057 - RNA, 31 nt, synthetic construct; identical to SEQ ID NO: 526
  misc_feature 1..31: note = Synthetic Oligonucleotide
  source 1..31: mol_type = other RNA

SEQ ID NO: 1058 - RNA, 31 nt, synthetic construct; identical to SEQ ID NO: 527
  misc_feature 1..31: note = Synthetic Oligonucleotide
  source 1..31: mol_type = other RNA

SEQ ID NO: 1059 - RNA, 31 nt, synthetic construct; identical to SEQ ID NO: 528
  misc_feature 1..31: note = Synthetic Oligonucleotide
  source 1..31: mol_type = other RNA

SEQ ID NO: 1060 - RNA, 31 nt, synthetic construct; identical to SEQ ID NO: 529
  misc_feature 1..31: note = Synthetic Oligonucleotide
  source 1..31: mol_type = other RNA

SEQ ID NO: 1061 - RNA, 31 nt, synthetic construct; identical to SEQ ID NO: 530
  misc_feature 1..31: note = Synthetic Oligonucleotide
  source 1..31: mol_type = other RNA

SEQ ID NO: 1062 - RNA, 31 nt, synthetic construct; identical to SEQ ID NO: 531
  misc_feature 1..31: note = Synthetic Oligonucleotide
  source 1..31: mol_type = other RNA

SEQ ID NO: 1063 - RNA, 31 nt, synthetic construct; identical to SEQ ID NO: 532
  misc_feature 1..31: note = Synthetic Oligonucleotide
  source 1..31: mol_type = other RNA

SEQ ID NO: 1064 - RNA, 31 nt, synthetic construct; identical to SEQ ID NO: 533
  misc_feature 1..31: note = Synthetic Oligonucleotide
  source 1..31: mol_type = other RNA

SEQ ID NO: 1065 - RNA, 31 nt, synthetic construct; identical to SEQ ID NO: 534
  misc_feature 1..31: note = Synthetic Oligonucleotide
  source 1..31: mol_type = other RNA

SEQ ID NO: 1066 - RNA, 31 nt, synthetic construct; identical to SEQ ID NO: 535
  misc_feature 1..31: note = Synthetic Oligonucleotide
  source 1..31: mol_type = other RNA

SEQ ID NO: 1067 - RNA, 31 nt, synthetic construct; identical to SEQ ID NO: 536
  misc_feature 1..31: note = Synthetic Oligonucleotide
  source 1..31: mol_type = other RNA

SEQ ID NO: 1068 - RNA, 31 nt, synthetic construct; identical to SEQ ID NO: 389
  misc_feature 1..31: note = Synthetic Oligonucleotide
  source 1..31: mol_type = other RNA

SEQ ID NO: 1069 - RNA, 31 nt, synthetic construct; identical to SEQ ID NO: 538
  misc_feature 1..31: note = Synthetic Oligonucleotide
  source 1..31: mol_type = other RNA

SEQ ID NO: 1070 - RNA, 31 nt, synthetic construct; identical to SEQ ID NO: 539
  misc_feature 1..31: note = Synthetic Oligonucleotide
  source 1..31: mol_type = other RNA

SEQ ID NO: 1071 - RNA, 31 nt, synthetic construct; identical to SEQ ID NO: 540
  misc_feature 1..31: note = Synthetic Oligonucleotide
  source 1..31: mol_type = other RNA

SEQ ID NO: 1072 - RNA, 31 nt, synthetic construct; identical to SEQ ID NO: 541
  misc_feature 1..31: note = Synthetic Oligonucleotide
  source 1..31: mol_type = other RNA

SEQ ID NO: 1073 - RNA, 31 nt, synthetic construct; identical to SEQ ID NO: 542
  misc_feature 1..31: note = Synthetic Oligonucleotide
  source 1..31: mol_type = other RNA

SEQ ID NO: 1074 - RNA, 31 nt, synthetic construct; identical to SEQ ID NO: 543
  misc_feature 1..31: note = Synthetic Oligonucleotide
  source 1..31: mol_type = other RNA

SEQ ID NO: 1075 - RNA, 31 nt, synthetic construct; identical to SEQ ID NO: 544
  misc_feature 1..31: note = Synthetic Oligonucleotide
  source 1..31: mol_type = other RNA

SEQ ID NO: 1076 - RNA, 31 nt, synthetic construct; identical to SEQ ID NO: 545
  misc_feature 1..31: note = Synthetic Oligonucleotide
  source 1..31: mol_type = other RNA

SEQ ID NO: 1077 - RNA, 31 nt, synthetic construct; identical to SEQ ID NO: 546
  misc_feature 1..31: note = Synthetic Oligonucleotide
  source 1..31: mol_type = other RNA

SEQ ID NO: 1078 - RNA, 31 nt, synthetic construct; identical to SEQ ID NO: 547
  misc_feature 1..31: note = Synthetic Oligonucleotide
  source 1..31: mol_type = other RNA

SEQ ID NO: 1079 - RNA, 31 nt, synthetic construct; identical to SEQ ID NO: 548
  misc_feature 1..31: note = Synthetic Oligonucleotide
  source 1..31: mol_type = other RNA

SEQ ID NO: 1080 - RNA, 31 nt, synthetic construct; identical to SEQ ID NO: 392
  misc_feature 1..31: note = Synthetic Oligonucleotide
  source 1..31: mol_type = other RNA

SEQ ID NO: 1081 - RNA, 31 nt, synthetic construct; identical to SEQ ID NO: 550
  misc_feature 1..31: note = Synthetic Oligonucleotide
  source 1..31: mol_type = other RNA

SEQ ID NO: 1082 - RNA, 31 nt, synthetic construct; identical to SEQ ID NO: 551
  misc_feature 1..31: note = Synthetic Oligonucleotide
  source 1..31: mol_type = other RNA

SEQ ID NO: 1083 - RNA, 31 nt, synthetic construct; identical to SEQ ID NO: 552
  misc_feature 1..31: note = Synthetic Oligonucleotide
  source 1..31: mol_type = other RNA

SEQ ID NO: 1084 - RNA, 31 nt, synthetic construct; identical to SEQ ID NO: 553
  misc_feature 1..31: note = Synthetic Oligonucleotide
  source 1..31: mol_type = other RNA

SEQ ID NO: 1085 - RNA, 31 nt, synthetic construct; identical to SEQ ID NO: 554
  misc_feature 1..31: note = Synthetic Oligonucleotide
  source 1..31: mol_type = other RNA

SEQ ID NO: 1086 - RNA, 31 nt, synthetic construct; identical to SEQ ID NO: 555
  misc_feature 1..31: note = Synthetic Oligonucleotide
  source 1..31: mol_type = other RNA

SEQ ID NO: 1087 - RNA, 31 nt, synthetic construct; identical to SEQ ID NO: 556
  misc_feature 1..31: note = Synthetic Oligonucleotide
  source 1..31: mol_type = other RNA

SEQ ID NO: 1088 - RNA, 31 nt, synthetic construct; identical to SEQ ID NO: 557
  misc_feature 1..31: note = Synthetic Oligonucleotide
  source 1..31: mol_type = other RNA

SEQ ID NO: 1089 - RNA, 31 nt, synthetic construct; identical to SEQ ID NO: 558
  misc_feature 1..31: note = Synthetic Oligonucleotide
  source 1..31: mol_type = other RNA

SEQ ID NO: 1090 - RNA, 31 nt, synthetic construct; identical to SEQ ID NO: 394
  misc_feature 1..31: note = Synthetic Oligonucleotide
  source 1..31: mol_type = other RNA

SEQ ID NO: 1091 - RNA, 31 nt, synthetic construct; identical to SEQ ID NO: 560
  misc_feature 1..31: note = Synthetic Oligonucleotide
  source 1..31: mol_type = other RNA

SEQ ID NO: 1092 - RNA, 31 nt, synthetic construct; identical to SEQ ID NO: 561
  misc_feature 1..31: note = Synthetic Oligonucleotide
  source 1..31: mol_type = other RNA

SEQ ID NO: 1093 - RNA, 31 nt, synthetic construct; identical to SEQ ID NO: 562
  misc_feature 1..31: note = Synthetic Oligonucleotide
  source 1..31: mol_type = other RNA

SEQ ID NO: 1094 - RNA, 31 nt, synthetic construct; identical to SEQ ID NO: 563
  misc_feature 1..31: note = Synthetic Oligonucleotide
  source 1..31: mol_type = other RNA

SEQ ID NO: 1095 - RNA, 31 nt, synthetic construct; identical to SEQ ID NO: 564
  misc_feature 1..31: note = Synthetic Oligonucleotide
  source 1..31: mol_type = other RNA

SEQ ID NO: 1096 - RNA, 31 nt, synthetic construct; identical to SEQ ID NO: 565
  misc_feature 1..31: note = Synthetic Oligonucleotide
  source 1..31: mol_type = other RNA

SEQ ID NO: 1097 - RNA, 31 nt, synthetic construct; identical to SEQ ID NO: 566
  misc_feature 1..31: note = Synthetic Oligonucleotide
  source 1..31: mol_type = other RNA

SEQ ID NO: 1098 - RNA, 31 nt, synthetic construct; identical to SEQ ID NO: 567
  misc_feature 1..31: note = Synthetic Oligonucleotide
  source 1..31: mol_type = other RNA

SEQ ID NO: 1099 - RNA, 31 nt, synthetic construct; identical to SEQ ID NO: 568
  misc_feature 1..31: note = Synthetic Oligonucleotide
  source 1..31: mol_type = other RNA

SEQ ID NO: 1100 - RNA, 31 nt, synthetic construct; identical to SEQ ID NO: 569
  misc_feature 1..31: note = Synthetic Oligonucleotide
  source 1..31: mol_type = other RNA

SEQ ID NO: 1101 - RNA, 31 nt, synthetic construct; identical to SEQ ID NO: 570
  misc_feature 1..31: note = Synthetic Oligonucleotide
  source 1..31: mol_type = other RNA

SEQ ID NO: 1102 - RNA, 31 nt, synthetic construct; identical to SEQ ID NO: 571
  misc_feature 1..31: note = Synthetic Oligonucleotide
  source 1..31: mol_type = other RNA

SEQ ID NO: 1103 - RNA, 31 nt, synthetic construct; identical to SEQ ID NO: 572
  misc_feature 1..31: note = Synthetic Oligonucleotide
  source 1..31: mol_type = other RNA

SEQ ID NO: 1104 - RNA, 62 nt, synthetic construct
  misc_feature 1..62: note = Synthetic Oligonucleotide
  source 1..62: mol_type = other RNA
gcggtgaacctcttgggttgcttcctcttgagcggtgaacctcttgggttgcttcctcttga

SEQ ID NO: 1105 - RNA, 31 nt, synthetic construct; identical to SEQ ID NO: 574
  misc_feature 1..31: note = Synthetic Oligonucleotide
  source 1..31: mol_type = other RNA

SEQ ID NO: 1106 - RNA, 31 nt, synthetic construct; identical to SEQ ID NO: 575
  misc_feature 1..31: note = Synthetic Oligonucleotide
  source 1..31: mol_type = other RNA

SEQ ID NO: 1107 - RNA, 31 nt, synthetic construct; identical to SEQ ID NO: 576
  misc_feature 1..31: note = Synthetic Oligonucleotide
  source 1..31: mol_type = other RNA

SEQ ID NO: 1108 - RNA, 31 nt, synthetic construct; identical to SEQ ID NO: 577
  misc_feature 1..31: note = Synthetic Oligonucleotide
  source 1..31: mol_type = other RNA

SEQ ID NO: 1109 - RNA, 31 nt, synthetic construct; identical to SEQ ID NO: 578
  misc_feature 1..31: note = Synthetic Oligonucleotide
  source 1..31: mol_type = other RNA

SEQ ID NO: 1110 - RNA, 31 nt, synthetic construct; identical to SEQ ID NO: 579
  misc_feature 1..31: note = Synthetic Oligonucleotide
  source 1..31: mol_type = other RNA

SEQ ID NO: 1111 - RNA, 31 nt, synthetic construct; identical to SEQ ID NO: 580
  misc_feature 1..31: note = Synthetic Oligonucleotide
  source 1..31: mol_type = other RNA

SEQ ID NO: 1112 - RNA, 31 nt, synthetic construct; identical to SEQ ID NO: 581
  misc_feature 1..31: note = Synthetic Oligonucleotide
  source 1..31: mol_type = other RNA

SEQ ID NO: 1113 - RNA, 31 nt, synthetic construct; identical to SEQ ID NO: 582
  misc_feature 1..31: note = Synthetic Oligonucleotide
  source 1..31: mol_type = other RNA

SEQ ID NO: 1114 - RNA, 31 nt, synthetic construct; identical to SEQ ID NO: 583
  misc_feature 1..31: note = Synthetic Oligonucleotide
  source 1..31: mol_type = other RNA

SEQ ID NO: 1115 - RNA, 31 nt, synthetic construct; identical to SEQ ID NO: 584
  misc_feature 1..31: note = Synthetic Oligonucleotide
  source 1..31: mol_type = other RNA

SEQ ID NO: 1116 - RNA, 31 nt, synthetic construct; identical to SEQ ID NO: 585
  misc_feature 1..31: note = Synthetic Oligonucleotide
  source 1..31: mol_type = other RNA

SEQ ID NO: 1117 - RNA, 31 nt, synthetic construct; identical to SEQ ID NO: 586
  misc_feature 1..31: note = Synthetic Oligonucleotide
  source 1..31: mol_type = other RNA

SEQ ID NO: 1118 - RNA, 31 nt, synthetic construct; identical to SEQ ID NO: 587
  misc_feature 1..31: note = Synthetic Oligonucleotide
  source 1..31: mol_type = other RNA

SEQ ID NO: 1119 - RNA, 31 nt, synthetic construct; identical to SEQ ID NO: 588
  misc_feature 1..31: note = Synthetic Oligonucleotide
  source 1..31: mol_type = other RNA

SEQ ID NO: 1120 - RNA, 31 nt, synthetic construct; identical to SEQ ID NO: 395
  misc_feature 1..31: note = Synthetic Oligonucleotide
  source 1..31: mol_type = other RNA

SEQ ID NO: 1121 - RNA, 31 nt, synthetic construct; identical to SEQ ID NO: 590
  misc_feature 1..31: note = Synthetic Oligonucleotide
  source 1..31: mol_type = other RNA

SEQ ID NO: 1122 - RNA, 31 nt, synthetic construct; identical to SEQ ID NO: 591
  misc_feature 1..31: note = Synthetic Oligonucleotide
  source 1..31: mol_type = other RNA

SEQ ID NO: 1123 - RNA, 31 nt, synthetic construct; identical to SEQ ID NO: 592
  misc_feature 1..31: note = Synthetic Oligonucleotide
  source 1..31: mol_type = other RNA

SEQ ID NO: 1124 - RNA, 31 nt, synthetic construct; identical to SEQ ID NO: 593
  misc_feature 1..31: note = Synthetic Oligonucleotide
  source 1..31: mol_type = other RNA

SEQ ID NO: 1125 - RNA, 31 nt, synthetic construct; identical to SEQ ID NO: 396
  misc_feature 1..31: note = Synthetic Oligonucleotide
  source 1..31: mol_type = other RNA

SEQ ID NO: 1126 - RNA, 31 nt, synthetic construct; identical to SEQ ID NO: 595
  misc_feature 1..31: note = Synthetic Oligonucleotide
  source 1..31: mol_type = other RNA

SEQ ID NO: 1127 - RNA, 31 nt, synthetic construct; identical to SEQ ID NO: 596
  misc_feature 1..31: note = Synthetic Oligonucleotide
  source 1..31: mol_type = other RNA

SEQ ID NO: 1128 - RNA, 31 nt, synthetic construct; identical to SEQ ID NO: 397
  misc_feature 1..31: note = Synthetic Oligonucleotide
  source 1..31: mol_type = other RNA

SEQ ID NO: 1129 - RNA, 31 nt, synthetic construct; identical to SEQ ID NO: 598
  misc_feature 1..31: note = Synthetic Oligonucleotide
  source 1..31: mol_type = other RNA

SEQ ID NO: 1130 - RNA, 31 nt, synthetic construct; identical to SEQ ID NO: 599
  misc_feature 1..31: note = Synthetic Oligonucleotide
  source 1..31: mol_type = other RNA

SEQ ID NO: 1131 - RNA, 31 nt, synthetic construct; identical to SEQ ID NO: 600
  misc_feature 1..31: note = Synthetic Oligonucleotide
  source 1..31: mol_type = other RNA

SEQ ID NO: 1132 - RNA, 31 nt, synthetic construct; identical to SEQ ID NO: 601
  misc_feature 1..31: note = Synthetic Oligonucleotide
  source 1..31: mol_type = other RNA

SEQ ID NO: 1133 - RNA, 31 nt, synthetic construct; identical to SEQ ID NO: 398
  misc_feature 1..31: note = Synthetic Oligonucleotide
  source 1..31: mol_type = other RNA

SEQ ID NO: 1134 - RNA, 31 nt, synthetic construct; identical to SEQ ID NO: 603
  misc_feature 1..31: note = Synthetic Oligonucleotide
  source 1..31: mol_type = other RNA

SEQ ID NO: 1135 - RNA, 31 nt, synthetic construct; identical to SEQ ID NO: 604
  misc_feature 1..31: note = Synthetic Oligonucleotide
  source 1..31: mol_type = other RNA

SEQ ID NO: 1136 - RNA, 31 nt, synthetic construct; identical to SEQ ID NO: 400
  misc_feature 1..31: note = Synthetic Oligonucleotide
  source 1..31: mol_type = other RNA

SEQ ID NO: 1137 - RNA, 31 nt, synthetic construct
  misc_feature 1..31: note = Synthetic Oligonucleotide
  source 1..31: mol_type = other RNA
gtgcgggggtacatcggcaggtcaatggtat

SEQ ID NO: 1138 - RNA, 31 nt, synthetic construct
  misc_feature 1..31: note = Synthetic Oligonucleotide
  source 1..31: mol_type = other RNA
gtgcggggggacatcggcaggtcaatggtat

SEQ ID NO: 1139 - RNA, 31 nt, synthetic construct
  misc_feature 1..31: note = Synthetic Oligonucleotide
  source 1..31: mol_type = other RNA
gtgcgggggaacatcggcaggtcaatggtat

SEQ ID NO: 1140 - RNA, 31 nt, synthetic construct; identical to SEQ ID NO: 402
  misc_feature 1..31: note = Synthetic Oligonucleotide
  source 1..31: mol_type = other RNA

SEQ ID NO: 1141 - RNA, 31 nt, synthetic construct
  misc_feature 1..31: note = Synthetic Oligonucleotide
  source 1..31: mol_type = other RNA
gcctcaggatacatggggagcaggttgtctg

SEQ ID NO: 1142 - RNA, 31 nt, synthetic construct
  misc_feature 1..31: note = Synthetic Oligonucleotide
  source 1..31: mol_type = other RNA
gcctcaggagacatggggagcaggttgtctg

SEQ ID NO: 1143 - RNA, 31 nt, synthetic construct
  misc_feature 1..31: note = Synthetic Oligonucleotide
  source 1..31: mol_type = other RNA
gcctcaggaaacatggggagcaggttgtctg

SEQ ID NO: 1144 - RNA, 51 nt, synthetic construct; identical to SEQ ID NO: 401
  misc_feature 1..51: note = Synthetic Oligonucleotide
  source 1..51: mol_type = other RNA

SEQ ID NO: 1145 - RNA, 51 nt, synthetic construct
  misc_feature 1..51: note = Synthetic Oligonucleotide
  source 1..51: mol_type = other RNA
gcaactcagtcttgatatatccagttcctttagggccatcaagttccattg

SEQ ID NO: 1146 - RNA, 51 nt, synthetic construct
  misc_feature 1..51: note = Synthetic Oligonucleotide
  source 1..51: mol_type = other RNA
gcaactcagtcttgatagatccagttcctttagggccatcaagttccattg

SEQ ID NO: 1147 - RNA, 51 nt, synthetic construct; identical to SEQ ID NO: 399
  misc_feature 1..51: note = Synthetic Oligonucleotide
  source 1..51: mol_type = other RNA

SEQ ID NO: 1148 - RNA, 30 nt, synthetic construct
  misc_feature 1..30: note = Synthetic Oligonucleotide
  source 1..30: mol_type = other RNA
gggggacatcggcaggtcaatggtattgct

SEQ ID NO: 1149 - RNA, 30 nt, synthetic construct
  misc_feature 1..30: note = Synthetic Oligonucleotide
  source 1..30: mol_type = other RNA
cggggggacatcggcaggtcaatggtattg

SEQ ID NO: 1150 - RNA, 30 nt, synthetic construct
  misc_feature 1..30: note = Synthetic Oligonucleotide
  source 1..30: mol_type = other RNA
agtgcggggggacatcggcaggtcaatggt

SEQ ID NO: 1151 - RNA, 30 nt, synthetic construct
  misc_feature 1..30: note = Synthetic Oligonucleotide
  source 1..30: mol_type = other RNA
aggagacatggggagcaggttgtctgtggt

SEQ ID NO: 1152 - RNA, 30 nt, synthetic construct
  misc_feature 1..30: note = Synthetic Oligonucleotide
  source 1..30: mol_type = other RNA
tcaggagacatggggagcaggttgtctgtg

SEQ ID NO: 1153 - RNA, 30 nt, synthetic construct
  misc_feature 1..30: note = Synthetic Oligonucleotide
  source 1..30: mol_type = other RNA
ctcctcaggagacatggggagcaggttgtc

SEQ ID NO: 1154 - RNA, 31 nt, synthetic construct; identical to SEQ ID NO: 605
  misc_feature 1..31: note = Synthetic Oligonucleotide
  source 1..31: mol_type = other RNA

SEQ ID NO: 1155 - RNA, 31 nt, synthetic construct; identical to SEQ ID NO: 606
  misc_feature 1..31: note = Synthetic Oligonucleotide
  source 1..31: mol_type = other RNA

SEQ ID NO: 1156 - RNA, 31 nt, synthetic construct; identical to SEQ ID NO: 607
  misc_feature 1..31: note = Synthetic Oligonucleotide
  source 1..31: mol_type = other RNA

SEQ ID NO: 1157 - RNA, 31 nt, synthetic construct; identical to SEQ ID NO: 608
  misc_feature 1..31: note = Synthetic Oligonucleotide
  source 1..31: mol_type = other RNA

SEQ ID NO: 1158 - RNA, 31 nt, synthetic construct; identical to SEQ ID NO: 609
  misc_feature 1..31: note = Synthetic Oligonucleotide
  source 1..31: mol_type = other RNA

SEQ ID NO: 1159 - RNA, 31 nt, synthetic construct; identical to SEQ ID NO: 610
  misc_feature 1..31: note = Synthetic Oligonucleotide
  source 1..31: mol_type = other RNA

SEQ ID NO: 1160 - RNA, 31 nt, synthetic construct; identical to SEQ ID NO: 611
  misc_feature 1..31: note = Synthetic Oligonucleotide
  source 1..31: mol_type = other RNA

SEQ ID NO: 1161 - RNA, 31 nt, synthetic construct; identical to SEQ ID NO: 612
  misc_feature 1..31: note = Synthetic Oligonucleotide
  source 1..31: mol_type = other RNA

SEQ ID NO: 1162 - RNA, 31 nt, synthetic construct; identical to SEQ ID NO: 613
  misc_feature 1..31: note = Synthetic Oligonucleotide
  source 1..31: mol_type = other RNA

SEQ ID NO: 1163 - RNA, 31 nt, synthetic construct; identical to SEQ ID NO: 614
  misc_feature 1..31: note = Synthetic Oligonucleotide
  source 1..31: mol_type = other RNA

SEQ ID NO: 1164 - RNA, 31 nt, synthetic construct; identical to SEQ ID NO: 615
  misc_feature 1..31: note = Synthetic Oligonucleotide
  source 1..31: mol_type = other RNA

SEQ ID NO: 1165 - RNA, 31 nt, synthetic construct; identical to SEQ ID NO: 616
  misc_feature 1..31: note = Synthetic Oligonucleotide
  source 1..31: mol_type = other RNA

SEQ ID NO: 1166 - RNA, 31 nt, synthetic construct; identical to SEQ ID NO: 617
  misc_feature 1..31: note = Synthetic Oligonucleotide
  source 1..31: mol_type = other RNA

SEQ ID NO: 1167 - RNA, 31 nt, synthetic construct; identical to SEQ ID NO: 618
  misc_feature 1..31: note = Synthetic Oligonucleotide
  source 1..31: mol_type = other RNA

SEQ ID NO: 1168 - RNA, 31 nt, synthetic construct; identical to SEQ ID NO: 619
  misc_feature 1..31: note = Synthetic Oligonucleotide
  source 1..31: mol_type = other RNA

SEQ ID NO: 1169 - RNA, 31 nt, synthetic construct; identical to SEQ ID NO: 620
  misc_feature 1..31: note = Synthetic Oligonucleotide
  source 1..31: mol_type = other RNA

SEQ ID NO: 1170 - RNA, 31 nt, synthetic construct; identical to SEQ ID NO: 621
  misc_feature 1..31: note = Synthetic Oligonucleotide
  source 1..31: mol_type = other RNA

SEQ ID NO: 1171 - RNA, 31 nt, synthetic construct; identical to SEQ ID NO: 622
  misc_feature 1..31: note = Synthetic Oligonucleotide
  source 1..31: mol_type = other RNA

SEQ ID NO: 1172 - RNA, 31 nt, synthetic construct; identical to SEQ ID NO: 623
  misc_feature 1..31: note = Synthetic Oligonucleotide
  source 1..31: mol_type = other RNA

SEQ ID NO: 1173 - RNA, 31 nt, synthetic construct; identical to SEQ ID NO: 623
  misc_feature 1..31: note = Synthetic Oligonucleotide
  source 1..31: mol_type = other RNA

SEQ ID NO: 1174 - RNA, 31 nt, synthetic construct; identical to SEQ ID NO: 625
  misc_feature 1..31: note = Synthetic Oligonucleotide
  source 1..31: mol_type = other RNA

SEQ ID NO: 1175 - RNA, 31 nt, synthetic construct; identical to SEQ ID NO: 626
  misc_feature 1..31: note = Synthetic Oligonucleotide
  source 1..31: mol_type = other RNA

SEQ ID NO: 1176 - RNA, 31 nt, synthetic construct; identical to SEQ ID NO: 627
  misc_feature 1..31: note = Synthetic Oligonucleotide
  source 1..31: mol_type = other RNA

SEQ ID NO: 1177 - RNA, 31 nt, synthetic construct; identical to SEQ ID NO: 605
  misc_feature 1..31: note = Synthetic Oligonucleotide
  source 1..31: mol_type = other RNA

SEQ ID NO: 1178 - RNA, 31 nt, synthetic construct; identical to SEQ ID NO: 629
  misc_feature 1..31: note = Synthetic Oligonucleotide
  source 1..31: mol_type = other RNA

SEQ ID NO: 1179 - RNA, 31 nt, synthetic construct; identical to SEQ ID NO: 630
  misc_feature 1..31: note = Synthetic Oligonucleotide
  source 1..31: mol_type = other RNA

SEQ ID NO: 1180 - RNA, 31 nt, synthetic construct; identical to SEQ ID NO: 631
  misc_feature 1..31: note = Synthetic Oligonucleotide
  source 1..31: mol_type = other RNA

SEQ ID NO: 1181 - RNA, 31 nt, synthetic construct; identical to SEQ ID NO: 606
  misc_feature 1..31: note = Synthetic Oligonucleotide
  source 1..31: mol_type = other RNA

SEQ ID NO: 1182 - RNA, 31 nt, synthetic construct; identical to SEQ ID NO: 633
  misc_feature 1..31: note = Synthetic Oligonucleotide
  source 1..31: mol_type = other RNA

SEQ ID NO: 1183 - RNA, 31 nt, synthetic construct; identical to SEQ ID NO: 634
  misc_feature 1..31: note = Synthetic Oligonucleotide
  source 1..31: mol_type = other RNA

SEQ ID NO: 1184 - RNA, 31 nt, synthetic construct; identical to SEQ ID NO: 607
  misc_feature 1..31: note = Synthetic Oligonucleotide
  source 1..31: mol_type = other RNA

SEQ ID NO: 1185 - RNA, 31 nt, synthetic construct; identical to SEQ ID NO: 608
  misc_feature 1..31: note = Synthetic Oligonucleotide
  source 1..31: mol_type = other RNA

SEQ ID NO: 1186 - RNA, 31 nt, synthetic construct; identical to SEQ ID NO: 637
  misc_feature 1..31: note = Synthetic Oligonucleotide
  source 1..31: mol_type = other RNA

SEQ ID NO: 1187 - RNA, 31 nt, synthetic construct; identical to SEQ ID NO: 638
  misc_feature 1..31: note = Synthetic Oligonucleotide
  source 1..31: mol_type = other RNA

SEQ ID NO: 1188 - RNA, 31 nt, synthetic construct; identical to SEQ ID NO: 639
  misc_feature 1..31: note = Synthetic Oligonucleotide
  source 1..31: mol_type = other RNA

SEQ ID NO: 1189 - RNA, 31 nt, synthetic construct; identical to SEQ ID NO: 609
  misc_feature 1..31: note = Synthetic Oligonucleotide
  source 1..31: mol_type = other RNA

SEQ ID NO: 1190 - RNA, 31 nt, synthetic construct; identical to SEQ ID NO: 641
  misc_feature 1..31: note = Synthetic Oligonucleotide
  source 1..31: mol_type = other RNA

SEQ ID NO: 1191 - RNA, 31 nt, synthetic construct; identical to SEQ ID NO: 642
  misc_feature 1..31: note = Synthetic Oligonucleotide
  source 1..31: mol_type = other RNA

SEQ ID NO: 1192 - RNA, 31 nt, synthetic construct; identical to SEQ ID NO: 610
  misc_feature 1..31: note = Synthetic Oligonucleotide
  source 1..31: mol_type = other RNA

SEQ ID NO: 1193 - RNA, 31 nt, synthetic construct; identical to SEQ ID NO: 644
  misc_feature 1..31: note = Synthetic Oligonucleotide
  source 1..31: mol_type = other RNA

SEQ ID NO: 1194 - RNA, 31 nt, synthetic construct; identical to SEQ ID NO: 645
  misc_feature 1..31: note = Synthetic Oligonucleotide
  source 1..31: mol_type = other RNA

SEQ ID NO: 1195 - RNA, 31 nt, synthetic construct; identical to SEQ ID NO: 611
  misc_feature 1..31: note = Synthetic Oligonucleotide
  source 1..31: mol_type = other RNA

SEQ ID NO: 1196 - RNA, 31 nt, synthetic construct; identical to SEQ ID NO: 647
  misc_feature 1..31: note = Synthetic Oligonucleotide
  source 1..31: mol_type = other RNA

SEQ ID NO: 1197 - RNA, 31 nt, synthetic construct; identical to SEQ ID NO: 648
  misc_feature 1..31: note = Synthetic Oligonucleotide
  source 1..31: mol_type = other RNA

SEQ ID NO: 1198 - RNA, 31 nt, synthetic construct; identical to SEQ ID NO: 649
  misc_feature 1..31: note = Synthetic Oligonucleotide
  source 1..31: mol_type = other RNA

SEQ ID NO: 1199 - RNA, 31 nt, synthetic construct; identical to SEQ ID NO: 612
  misc_feature 1..31: note = Synthetic Oligonucleotide
  source 1..31: mol_type = other RNA

SEQ ID NO: 1200 - RNA, 31 nt, synthetic construct; identical to SEQ ID NO: 651
  misc_feature 1..31: note = Synthetic Oligonucleotide
  source 1..31: mol_type = other RNA

SEQ ID NO: 1201 - RNA, 31 nt, synthetic construct; identical to SEQ ID NO: 652
  misc_feature 1..31: note = Synthetic Oligonucleotide
  source 1..31: mol_type = other RNA

SEQ ID NO: 1202 - RNA, 31 nt, synthetic construct; identical to SEQ ID NO: 613
  misc_feature 1..31: note = Synthetic Oligonucleotide
  source 1..31: mol_type = other RNA

SEQ ID NO: 1203 - RNA, 31 nt, synthetic construct; identical to SEQ ID NO: 654
  misc_feature 1..31: note = Synthetic Oligonucleotide
  source 1..31: mol_type = other RNA

SEQ ID NO: 1204 - RNA, 31 nt, synthetic construct; identical to SEQ ID NO: 614
  misc_feature 1..31: note = Synthetic Oligonucleotide
  source 1..31: mol_type = other RNA

SEQ ID NO: 1205 - RNA, 31 nt, synthetic construct; identical to SEQ ID NO: 656
  misc_feature 1..31: note = Synthetic Oligonucleotide
  source 1..31: mol_type = other RNA

SEQ ID NO: 1206 - RNA, 31 nt, synthetic construct; identical to SEQ ID NO: 657
  misc_feature 1..31: note = Synthetic Oligonucleotide
  source 1..31: mol_type = other RNA

SEQ ID NO: 1207 - RNA, 31 nt, synthetic construct; identical to SEQ ID NO: 658
  misc_feature 1..31: note = Synthetic Oligonucleotide
  source 1..31: mol_type = other RNA

SEQ ID NO: 1208 - RNA, 31 nt, synthetic construct; identical to SEQ ID NO: 615
  misc_feature 1..31: note = Synthetic Oligonucleotide
  source 1..31: mol_type = other RNA

SEQ ID NO: 1209 - RNA, 31 nt, synthetic construct; identical to SEQ ID NO: 660
  misc_feature 1..31: note = Synthetic Oligonucleotide
  source 1..31: mol_type = other RNA

SEQ ID NO: 1210 - RNA, 31 nt, synthetic construct; identical to SEQ ID NO: 661
  misc_feature 1..31: note = Synthetic Oligonucleotide
  source 1..31: mol_type = other RNA

SEQ ID NO: 1211 - RNA, 31 nt, synthetic construct; identical to SEQ ID NO: 616
  misc_feature 1..31: note = Synthetic Oligonucleotide
  source 1..31: mol_type = other RNA

SEQ ID NO: 1212 - RNA, 31 nt, synthetic construct; identical to SEQ ID NO: 663
  misc_feature 1..31: note = Synthetic Oligonucleotide
  source 1..31: mol_type = other RNA

SEQ ID NO: 1213 - RNA, 31 nt, synthetic construct; identical to SEQ ID NO: 664
  misc_feature 1..31: note = Synthetic Oligonucleotide
  source 1..31: mol_type = other RNA

SEQ ID NO: 1214 - RNA, 31 nt, synthetic construct; identical to SEQ ID NO: 617
  misc_feature 1..31: note = Synthetic Oligonucleotide
  source 1..31: mol_type = other RNA

SEQ ID NO: 1215 - RNA, 31 nt, synthetic construct; identical to SEQ ID NO: 666
  misc_feature 1..31: note = Synthetic Oligonucleotide
  source 1..31: mol_type = other RNA

SEQ ID NO: 1216 - RNA, 31 nt, synthetic construct; identical to SEQ ID NO: 667
  misc_feature 1..31: note = Synthetic Oligonucleotide
  source 1..31: mol_type = other RNA

SEQ ID NO: 1217 - RNA, 31 nt, synthetic construct; identical to SEQ ID NO: 618
  misc_feature 1..31: note = Synthetic Oligonucleotide
  source 1..31: mol_type = other RNA

SEQ ID NO: 1218 - RNA, 31 nt, synthetic construct; identical to SEQ ID NO: 619
  misc_feature 1..31: note = Synthetic Oligonucleotide
  source 1..31: mol_type = other RNA

SEQ ID NO: 1219 - RNA, 31 nt, synthetic construct; identical to SEQ ID NO: 670
  misc_feature 1..31: note = Synthetic Oligonucleotide
  source 1..31: mol_type = other RNA

SEQ ID NO: 1220 - RNA, 31 nt, synthetic construct; identical to SEQ ID NO: 671
  misc_feature 1..31: note = Synthetic Oligonucleotide
  source 1..31: mol_type = other RNA

SEQ ID NO: 1221 - RNA, 31 nt, synthetic construct; identical to SEQ ID NO: 672
  misc_feature 1..31: note = Synthetic Oligonucleotide
  source 1..31: mol_type = other RNA

SEQ ID NO: 1222 - RNA, 31 nt, synthetic construct; identical to SEQ ID NO: 673
  misc_feature 1..31: note = Synthetic Oligonucleotide
  source 1..31: mol_type = other RNA

SEQ ID NO: 1223 - RNA, 31 nt, synthetic construct; identical to SEQ ID NO: 620
  misc_feature 1..31: note = Synthetic Oligonucleotide
  source 1..31: mol_type = other RNA

SEQ ID NO: 1224 - RNA, 31 nt, synthetic construct; identical to SEQ ID NO: 675
  misc_feature 1..31: note = Synthetic Oligonucleotide
  source 1..31: mol_type = other RNA

SEQ ID NO: 1225 - RNA, 31 nt, synthetic construct; identical to SEQ ID NO: 676
  misc_feature 1..31: note = Synthetic Oligonucleotide
  source 1..31: mol_type = other RNA

SEQ ID NO: 1226 - RNA, 31 nt, synthetic construct; identical to SEQ ID NO: 621
  misc_feature 1..31: note = Synthetic Oligonucleotide
  source 1..31: mol_type = other RNA

SEQ ID NO: 1227 - RNA, 31 nt, synthetic construct; identical to SEQ ID NO: 678
  misc_feature 1..31: note = Synthetic Oligonucleotide
  source 1..31: mol_type = other RNA

SEQ ID NO: 1228 - RNA, 31 nt, synthetic construct; identical to SEQ ID NO: 679
  misc_feature 1..31: note = Synthetic Oligonucleotide
  source 1..31: mol_type = other RNA

SEQ ID NO: 1229 - RNA, 31 nt, synthetic construct; identical to SEQ ID NO: 622
  misc_feature 1..31: note = Synthetic Oligonucleotide
  source 1..31: mol_type = other RNA

SEQ ID NO: 1230 - RNA, 31 nt, synthetic construct; identical to SEQ ID NO: 681
  misc_feature 1..31: note = Synthetic Oligonucleotide
  source 1..31: mol_type = other RNA

SEQ ID NO: 1231 - RNA, 31 nt, synthetic construct; identical to SEQ ID NO: 682
  misc_feature 1..31: note = Synthetic Oligonucleotide
  source 1..31: mol_type = other RNA

SEQ ID NO: 1232 - RNA, 31 nt, synthetic construct; identical to SEQ ID NO: 623
  misc_feature 1..31: note = Synthetic Oligonucleotide
  source 1..31: mol_type = other RNA

SEQ ID NO: 1233 - RNA, 31 nt, synthetic construct; identical to SEQ ID NO: 684
  misc_feature 1..31: note = Synthetic Oligonucleotide
  source 1..31: mol_type = other RNA

SEQ ID NO: 1234 - RNA, 31 nt, synthetic construct; identical to SEQ ID NO: 685
  misc_feature 1..31: note = Synthetic Oligonucleotide
  source 1..31: mol_type = other RNA

SEQ ID NO: 1235 - RNA, 31 nt, synthetic construct; identical to SEQ ID NO: 686
  misc_feature 1..31: note = Synthetic Oligonucleotide
  source 1..31: mol_type = other RNA

SEQ ID NO: 1236 - RNA, 31 nt, synthetic construct; identical to SEQ ID NO: 687
  misc_feature 1..31: note = Synthetic Oligonucleotide
  source 1..31: mol_type = other RNA

SEQ ID NO: 1237 - RNA, 31 nt, synthetic construct; identical to SEQ ID NO: 625
  misc_feature 1..31: note = Synthetic Oligonucleotide
  source 1..31: mol_type = other RNA

SEQ ID NO: 1238 - RNA, 31 nt, synthetic construct; identical to SEQ ID NO: 689
  misc_feature 1..31: note = Synthetic Oligonucleotide
  source 1..31: mol_type = other RNA

SEQ ID NO: 1239 - RNA, 31 nt, synthetic construct; identical to SEQ ID NO: 626
  misc_feature 1..31: note = Synthetic Oligonucleotide
  source 1..31: mol_type = other RNA

SEQ ID NO: 1240 - RNA, 31 nt, synthetic construct; identical to SEQ ID NO: 691
  misc_feature 1..31: note = Synthetic Oligonucleotide
  source 1..31: mol_type = other RNA

SEQ ID NO: 1241 - RNA, 31 nt, synthetic construct; identical to SEQ ID NO: 692
  misc_feature 1..31: note = Synthetic Oligonucleotide
  source 1..31: mol_type = other RNA

SEQ ID NO: 1242 - RNA, 31 nt, synthetic construct; identical to SEQ ID NO: 693
  misc_feature 1..31: note = Synthetic Oligonucleotide
  source 1..31: mol_type = other RNA

SEQ ID NO: 1243 - RNA, 31 nt, synthetic construct; identical to SEQ ID NO: 694
  misc_feature 1..31: note = Synthetic Oligonucleotide
  source 1..31: mol_type = other RNA

SEQ ID NO: 1244 - RNA, 31 nt, synthetic construct; identical to SEQ ID NO: 695
  misc_feature 1..31: note = Synthetic Oligonucleotide
  source 1..31: mol_type = other RNA

SEQ ID NO: 1245 - RNA, 31 nt, synthetic construct; identical to SEQ ID NO: 696
  misc_feature 1..31: note = Synthetic Oligonucleotide
  source 1..31: mol_type = other RNA

SEQ ID NO: 1246 - RNA, 31 nt, synthetic construct; identical to SEQ ID NO: 697
  misc_feature 1..31: note = Synthetic Oligonucleotide
  source 1..31: mol_type = other RNA

SEQ ID NO: 1247 - RNA, 31 nt, synthetic construct; identical to SEQ ID NO: 698
  misc_feature 1..31: note = Synthetic Oligonucleotide
  source 1..31: mol_type = other RNA

SEQ ID NO: 1248 - RNA, 31 nt, synthetic construct; identical to SEQ ID NO: 699
  misc_feature 1..31: note = Synthetic Oligonucleotide
  source 1..31: mol_type = other RNA

SEQ ID NO: 1249 - RNA, 31 nt, synthetic construct; identical to SEQ ID NO: 700
  misc_feature 1..31: note = Synthetic Oligonucleotide
  source 1..31: mol_type = other RNA

SEQ ID NO: 1250 - RNA, 31 nt, synthetic construct
  misc_feature 1..31: note = Synthetic Oligonucleotide
  source 1..31: mol_type = other RNA
gtcacgtcctccatgtccgcgcccagccggg

SEQ ID NO: 1251 - RNA, 31 nt, synthetic construct
  misc_feature 1..31: note = Synthetic Oligonucleotide
  source 1..31: mol_type = other RNA
ggctcacgtcctccatgtccgcgcccagccg

SEQ ID NO: 1252 - RNA, 31 nt, synthetic construct
  misc_feature 1..31: note = Synthetic Oligonucleotide
  source 1..31: mol_type = other RNA
gccgctcacgtcctccatgtccgcgcccagc

SEQ ID NO: 1253 - RNA, 31 nt, synthetic construct
  misc_feature 1..31: note = Synthetic Oligonucleotide
  source 1..31: mol_type = other RNA
gggccgctcacgtcctccatgtccgcgccca

SEQ ID NO: 1254 - RNA, 31 nt, synthetic construct
  misc_feature 1..31: note = Synthetic Oligonucleotide
  source 1..31: mol_type = other RNA
ggcggccgctcacgtcctccatgtccgcgcc

SEQ ID NO: 1255 - RNA, 31 nt, synthetic construct
  misc_feature 1..31: note = Synthetic Oligonucleotide
  source 1..31: mol_type = other RNA
gaggcggccgctcacgtcctccatgtccgcg

SEQ ID NO: 1256 - RNA, 31 nt, synthetic construct
  misc_feature 1..31: note = Synthetic Oligonucleotide
  source 1..31: mol_type = other RNA
gccaggcggccgctcacgtcctccatgtccg

SEQ ID NO: 1257 - RNA, 31 nt, synthetic construct
  misc_feature 1..31: note = Synthetic Oligonucleotide
  source 1..31: mol_type = other RNA
gcaccaggcggccgctcacgtcctccatgtc

SEQ ID NO: 1258 - RNA, 31 nt, synthetic construct; identical to SEQ ID NO: 701
  misc_feature 1..31: note = Synthetic Oligonucleotide
  source 1..31: mol_type = other RNA

SEQ ID NO: 1259 - RNA, 31 nt, synthetic construct; identical to SEQ ID NO: 702
  misc_feature 1..31: note = Synthetic Oligonucleotide
  source 1..31: mol_type = other RNA

SEQ ID NO: 1260 - RNA, 31 nt, synthetic construct; identical to SEQ ID NO: 703
  misc_feature 1..31: note = Synthetic Oligonucleotide
  source 1..31: mol_type = other RNA

SEQ ID NO: 1261 - RNA, 31 nt, synthetic construct; identical to SEQ ID NO: 704
  misc_feature 1..31: note = Synthetic Oligonucleotide
  source 1..31: mol_type = other RNA

SEQ ID NO: 1262 - RNA, 31 nt, synthetic construct; identical to SEQ ID NO: 705
  misc_feature 1..31: note = Synthetic Oligonucleotide
  source 1..31: mol_type = other RNA

SEQ ID NO: 1263 - RNA, 31 nt, synthetic construct; identical to SEQ ID NO: 706
  misc_feature 1..31: note = Synthetic Oligonucleotide
  source 1..31: mol_type = other RNA

SEQ ID NO: 1264 - RNA, 31 nt, synthetic construct; identical to SEQ ID NO: 707
  misc_feature 1..31: note = Synthetic Oligonucleotide
  source 1..31: mol_type = other RNA

SEQ ID NO: 1265 - RNA, 31 nt, synthetic construct; identical to SEQ ID NO: 708
  misc_feature 1..31: note = Synthetic Oligonucleotide
  source 1..31: mol_type = other RNA

SEQ ID NO: 1266 - RNA, 31 nt, synthetic construct
  misc_feature 1..31: note = Synthetic Oligonucleotide
  source 1..31: mol_type = other RNA
gtcttctgcaggtcatcggcatcgcggagga

SEQ ID NO: 1267 - RNA, 31 nt, synthetic construct
  misc_feature 1..31: note = Synthetic Oligonucleotide
  source 1..31: mol_type = other RNA
ggctcttctgcaggtcatcggcatcgcggag

SEQ ID NO: 1268 - RNA, 31 nt, synthetic construct
  misc_feature 1..31: note = Synthetic Oligonucleotide
  source 1..31: mol_type = other RNA
gaggctcttctgcaggtcatcggcatcgcgg

SEQ ID NO: 1269 - RNA, 31 nt, synthetic construct
  misc_feature 1..31: note = Synthetic Oligonucleotide
  source 1..31: mol_type = other RNA
gccaggctcttctgcaggtcatcggcatcgc

SEQ ID NO: 1270 - RNA, 31 nt, synthetic construct
  misc_feature 1..31: note = Synthetic Oligonucleotide
  source 1..31: mol_type = other RNA
gtgccaggctcttctgcaggtcatcggcatc

SEQ ID NO: 1271 - RNA, 31 nt, synthetic construct
  misc_feature 1..31: note = Synthetic Oligonucleotide
  source 1..31: mol_type = other RNA
gactgccaggctcttctgcaggtcatcggca

SEQ ID NO: 1272 - RNA, 31 nt, synthetic construct
  misc_feature 1..31: note = Synthetic Oligonucleotide
  source 1..31: mol_type = other RNA
gacactgccaggctcttctgcaggtcatcgg

SEQ ID NO: 1273 - RNA, 31 nt, synthetic construct
  misc_feature 1..31: note = Synthetic Oligonucleotide
  source 1..31: mol_type = other RNA
ggtacactgccaggctcttctgcaggtcatc

SEQ ID NO: 1274 - RNA, 50 nt, synthetic construct; identical to SEQ ID NO: 711
  misc_feature 1..50: note = Synthetic Oligonucleotide
  source 1..50: mol_type = other RNA

SEQ ID NO: 1275 - RNA, 50 nt, synthetic construct; identical to SEQ ID NO: 709
  misc_feature 1..50: note = Synthetic Oligonucleotide
  source 1..50: mol_type = other RNA

SEQ ID NO: 1276 - RNA, 31 nt, synthetic construct; identical to SEQ ID NO: 710
  misc_feature 1..31: note = Synthetic Oligonucleotide
  source 1..31: mol_type = other RNA

SEQ ID NO: 1277 - RNA, 30 nt, synthetic construct
  misc_feature 1..30: note = Synthetic Oligonucleotide
  source 1..30: mol_type = other RNA
aatgtaatcgcaatctgaatcttggtttca

SEQ ID NO: 1278 - RNA, 30 nt, synthetic construct
  misc_feature 1..30: note = Synthetic Oligonucleotide
  source 1..30: mol_type = other RNA
ttaatgtaatcgcaatctgaatcttggttt

SEQ ID NO: 1279 - RNA, 30 nt, synthetic construct
  misc_feature 1..30: note = Synthetic Oligonucleotide
  source 1..30: mol_type = other RNA
ctttaatgtaatcgcaatctgaatcttggt

SEQ ID NO: 1280 - RNA, 30 nt, synthetic construct
  misc_feature 1..30: note = Synthetic Oligonucleotide
  source 1..30: mol_type = other RNA
ccctttaatgtaatcgcaatctgaatcttg

What is claimed is:

1. A non-naturally occurring or engineered composition comprising:

(a) a Type VI Cas protein comprising an amino acid sequence having at least 90% sequence identity to the amino acid sequence of SEQ ID NO. 274;

(b) a heterologous guide sequence capable of forming a complex with the Type VI Cas protein and directing the complex to bind to a target sequence; and (c) one or more functional domains wherein at least one of the one or more functional domains is an adenosine deaminase or a cytidine deaminase, and wherein the Type VI Cas protein is directly linked with the one or more functional domains.

2. The composition of claim 1, wherein the Type VI Cas protein comprises the amino acid sequence of SEQ ID NO. 274.

3. The composition of claim 1, wherein the Type VI Cas protein comprises one or more mutations in a HEPN domain that reduce collateral activity relative to a HEPN domain without one or more mutations.

4. The composition of claim 1, wherein the Type VI Cas protein comprises one or more mutations in a HEPN domain that renders the Type VI Cas protein catalytically inactive.

5. The composition of claim 4, wherein the one or more functional domains is an adenosine deaminase.

6. A polynucleotide comprising a nucleotide sequence encoding the composition of claim 1.

7. A delivery vehicle comprising the composition of claim 1 or a polynucleotide comprising a nucleotide sequence encoding the composition of claim 1.

8. The delivery vehicle of claim 7, wherein the polynucleotide is a mRNA.

9. The delivery vehicle of claim 7, wherein the delivery vehicle is a lipid nanoparticle or a viral vector, optionally, wherein the viral vector is an adenoassociated viral (AAV) vector.

10. A non-naturally occurring or engineered composition comprising:

(a) a Type VI Cas protein comprising an amino acid sequence having at least 90% sequence identity to the amino acid sequence of SEQ ID NO. 274;

(b) a nucleotide deaminase fused or linked to the Cas protein and (c) a guide sequence capable of forming a complex with the Type VI Cas protein and directing the complex to bind to a target sequence, wherein the Type VI Cas protein is catalytically inactive and comprises an N-terminal truncation, a C-terminal truncation, or both relative to the amino acid sequence of SEQ ID NO. 274.

11. The composition of claim 10, wherein the N-terminal or C-terminal truncation comprises at least 20 amino acids, at least 40 amino acids, at least 50 amino acids, or at least 60 amino acids relative to the amino acid sequence of SEQ ID NO: 274.

12. The composition of claim 10, wherein the nucleotide deaminase is an adenosine deaminase.

13. The composition of claim 10, wherein the nucleotide deaminase is a cytidine deaminase.

14. A polynucleotide comprising a nucleotide sequence encoding the composition of claim 10.

15. A delivery vehicle comprising the composition of claim 10 or a polynucleotide comprising a nucleotide sequence encoding the composition of claim 12.

16. The delivery vehicle of claim 15, wherein the polynucleotide is a mRNA.

17. The delivery vehicle of claim 15, wherein the delivery vehicle is a lipid nanoparticle or a viral vector, optionally, wherein the viral vector is an adenoassociated viral (AAV) vector.

18. A method of cleaving a target RNA, comprising contacting the target RNA with the composition of claim 1; wherein the Type VI Cas protein associates with the heterologous guide sequence to form a complex; wherein the complex binds to the target RNA; and wherein upon binding of the complex to the target RNA, the Type VI Cas protein cleaves the target RNA.

19. The method of claim 18, wherein the Type VI Cas protein comprises one or more mutations in a HEPN domain that eliminate or reduce a collateral activity of the Type VI Cas protein.

20. A method of editing a target RNA, comprising contacting the target RNA with the composition of claim 10, wherein the Type VI Cas protein associates with the guide sequence to form a complex, wherein the complex binds to the target RNA; and wherein upon binding of the complex to the target RNA, the nucleotide deaminase makes an A→G or C→T base edit.

* * * * *